(12) United States Patent
Posey et al.

(10) Patent No.: US 11,535,662 B2
(45) Date of Patent: Dec. 27, 2022

(54) CD28 COMPOSITIONS AND METHODS FOR CHIMERIC ANTIGEN RECEPTOR THERAPY

(71) Applicants: Novartis AG, Basel (CH); The Trustees of the University of Pennsylvania, Philadelphia, PA (US)

(72) Inventors: Avery D. Posey, Philadelphia, PA (US); Sonia Guedan Carrio, Philadelphia, PA (US)

(73) Assignees: Novartis AG, Basel (CH); The Trustees of the University of Pennsylvania, Philadelphia, PA (US)

(*) Notice: Subject to any disclaimer, the term of this patent is extended or adjusted under 35 U.S.C. 154(b) by 719 days.

(21) Appl. No.: 16/481,181

(22) PCT Filed: Jan. 26, 2018

(86) PCT No.: PCT/US2018/015447
§ 371 (c)(1),
(2) Date: Jul. 26, 2019

(87) PCT Pub. No.: WO2018/140725
PCT Pub. Date: Aug. 2, 2018

(65) Prior Publication Data
US 2019/0389928 A1 Dec. 26, 2019

Related U.S. Application Data

(60) Provisional application No. 62/450,947, filed on Jan. 26, 2017.

(51) Int. Cl.
| | | |
|---|---|---|
| *C07K 14/705* | (2006.01) | |
| *A61P 35/00* | (2006.01) | |
| *A61K 35/17* | (2015.01) | |
| *A61K 38/17* | (2006.01) | |
| *A61K 39/395* | (2006.01) | |
| *A61K 45/06* | (2006.01) | |
| *C07K 14/725* | (2006.01) | |
| *C07K 16/28* | (2006.01) | |
| *C12N 5/0783* | (2010.01) | |

(52) U.S. Cl.
CPC ........ *C07K 14/70521* (2013.01); *A61K 35/17* (2013.01); *A61K 38/1774* (2013.01); *A61K 39/3955* (2013.01); *A61K 45/06* (2013.01); *A61P 35/00* (2018.01); *C07K 14/7051* (2013.01); *C07K 16/2869* (2013.01); *C12N 5/0636* (2013.01); *C07K 2317/622* (2013.01); *C07K 2317/76* (2013.01); *C07K 2319/02* (2013.01); *C07K 2319/03* (2013.01); *C07K 2319/30* (2013.01); *C07K 2319/33* (2013.01); *C12N 2510/00* (2013.01)

(58) Field of Classification Search
None
See application file for complete search history.

(56) References Cited

U.S. PATENT DOCUMENTS

| | | |
|---|---|---|
| 2003/0147869 A1 | 8/2003 | Riley et al. |
| 2003/0224520 A1 | 12/2003 | June et al. |
| 2004/0101519 A1 | 5/2004 | June et al. |
| 2004/0110290 A1 | 6/2004 | June et al. |
| 2006/0034810 A1 | 2/2006 | Riley et al. |
| 2010/0261269 A1 | 10/2010 | June et al. |
| 2011/0262467 A1 | 10/2011 | Riley et al. |
| 2013/0071409 A1 | 3/2013 | Riley et al. |
| 2013/0287748 A1 | 10/2013 | June et al. |
| 2013/0288368 A1 | 10/2013 | June et al. |
| 2013/0309258 A1 | 11/2013 | June et al. |
| 2014/0050708 A1 | 2/2014 | Powell et al. |
| 2014/0099309 A1 | 4/2014 | Powell et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322183 A1 | 10/2014 | Milone et al. |

(Continued)

FOREIGN PATENT DOCUMENTS

| | | |
|---|---|---|
| EP | 0574512 B1 | 2/2003 |
| EP | 1226244 B1 | 7/2004 |

(Continued)

OTHER PUBLICATIONS

Harada et al, The Journal of Experimental Medicine, vol. 197, No. 2, Jan. 20, 2003 (Jan. 20, 2003), pp. 257-262. (Year: 2003).*

(Continued)

*Primary Examiner* — Zachary S Skelding
(74) *Attorney, Agent, or Firm* — K&L Gates LLP

(57) ABSTRACT

The invention provides compositions and methods for treating diseases associated with expression of a cancer associated antigen as described herein. The invention also relates to chimeric antigen receptor (CAR) specific to a cancer associated antigen as described herein, vectors encoding the same, and recombinant T cells comprising the CARs of the present invention. The invention also includes methods of administering a genetically modified T cell expressing a CAR that comprises an antigen binding domain that binds to a cancer associated antigen as described herein. The CAR may comprise a mutant CD28 costimulatory domain.

12 Claims, 6 Drawing Sheets

Specification includes a Sequence Listing.

(56) References Cited

U.S. PATENT DOCUMENTS

| | | | |
|---|---|---|---|
| 2014/0322212 A1 | 10/2014 | Brogdon et al. |
| 2014/0322216 A1 | 10/2014 | Kaplan |
| 2014/0322275 A1 | 10/2014 | Brogdon et al. |
| 2014/0370017 A1 | 12/2014 | June et al. |
| 2014/0370045 A1 | 12/2014 | June et al. |
| 2015/0017141 A1 | 1/2015 | June et al. |
| 2015/0024482 A1 | 1/2015 | Frigault et al. |
| 2015/0050729 A1 | 2/2015 | June et al. |
| 2015/0093822 A1 | 4/2015 | June et al. |
| 2015/0099299 A1 | 4/2015 | June et al. |
| 2015/0118202 A1 | 4/2015 | June et al. |
| 2015/0283178 A1 | 10/2015 | June et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0311907 A1 | 10/2016 | Brogdon et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhoneko et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 | 9/2018 | Motz et al. |
| 2018/0312595 A1 | 11/2018 | Brogdon et al. |
| 2019/0000880 A1 | 1/2019 | Motz et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0216908 A1* | 7/2019 | Klein ............... A61P 35/00 |
| 2019/0263914 A1 | 8/2019 | Brogdon et al. |
| 2019/0269727 A1 | 9/2019 | Fachin et al. |
| 2019/0292238 A1 | 9/2019 | Bitter et al. |
| 2019/0292257 A1 | 9/2019 | Bedoya et al. |
| 2019/0298715 A1 | 10/2019 | Motz et al. |
| 2019/0330356 A1 | 10/2019 | Brogdon et al. |
| 2019/0336504 A1 | 11/2019 | Gill et al. |
| 2019/0375815 A1 | 12/2019 | Engels et al. |
| 2019/0382500 A1 | 12/2019 | Abujoub et al. |
| 2019/0388471 A1 | 12/2019 | June et al. |
| 2019/0389928 A1 | 12/2019 | Posey et al. |
| 2020/0048359 A1 | 2/2020 | Albeda et al. |
| 2020/0055948 A1 | 2/2020 | Daley et al. |
| 2020/0087376 A1 | 3/2020 | Fraietta et al. |
| 2020/0113941 A1 | 4/2020 | Brannetti et al. |
| 2020/0179511 A1 | 6/2020 | Daley et al. |
| 2020/0215171 A1 | 7/2020 | Brogdon et al. |
| 2020/0281973 A1 | 9/2020 | Dranoff |
| 2020/0283729 A1 | 9/2020 | Loew et al. |
| 2020/0291354 A1 | 9/2020 | Johnson et al. |
| 2020/0339704 A1 | 10/2020 | Bradner et al. |
| 2020/0360431 A1 | 11/2020 | Garfall et al. |
| 2020/0370012 A1 | 11/2020 | Fraietta et al. |
| 2020/0371091 A1 | 11/2020 | Pruteanu-Malinici et al. |
| 2020/0399383 A1 | 12/2020 | Scholler et al. |
| 2021/0002377 A1 | 1/2021 | Brogdon et al. |
| 2021/0047405 A1 | 2/2021 | Nobles et al. |
| 2021/0079073 A1 | 3/2021 | Milone et al. |
| 2021/0087279 A1 | 3/2021 | Engels et al. |
| 2021/0139595 A1 | 5/2021 | Ebersbach et al. |
| 2021/0171909 A1 | 6/2021 | Golovina et al. |
| 2021/0172020 A1 | 6/2021 | Bedoya et al. |
| 2021/0177896 A1 | 6/2021 | Porter et al. |
| 2021/0177900 A1 | 6/2021 | Engels et al. |
| 2021/0213063 A1 | 7/2021 | Isaacs et al. |
| 2021/0214459 A1 | 7/2021 | Brock et al. |
| 2021/0220404 A1 | 7/2021 | Abujoub et al. |
| 2021/0246423 A1 | 8/2021 | Bedoya et al. |
| 2021/0284752 A1 | 9/2021 | Brogdon et al. |
| 2021/0317183 A1 | 10/2021 | Zhao et al. |
| 2021/0347851 A1 | 11/2021 | Isaacs et al. |
| 2021/0396739 A1 | 12/2021 | Pruteanu-Malinici et al. |
| 2022/0047633 A1 | 2/2022 | Grupp |
| 2022/0064316 A1 | 3/2022 | Brogdon et al. |
| 2022/0089750 A1 | 3/2022 | June et al. |
| 2022/0152150 A1 | 5/2022 | Koshy et al. |
| 2022/0168389 A1 | 6/2022 | Ghassemi et al. |

FOREIGN PATENT DOCUMENTS

| | | | |
|---|---|---|---|
| EP | 0871495 | B1 | 6/2005 |
| WO | 1992015322 | A1 | 9/1992 |
| WO | 199530014 | A1 | 11/1995 |
| WO | 9623814 | A1 | 8/1996 |
| WO | 9624671 | A1 | 8/1996 |
| WO | 1997015669 | A1 | 5/1997 |
| WO | 9723613 | A2 | 7/1997 |
| WO | 9818809 | A1 | 5/1998 |
| WO | 9900494 | A2 | 1/1999 |
| WO | 9957268 | A1 | 11/1999 |
| WO | 0014257 | A1 | 3/2000 |
| WO | 2002033101 | A1 | 4/2002 |
| WO | 02077029 | A2 | 10/2002 |
| WO | 02088334 | A1 | 11/2002 |
| WO | 2003057171 | A2 | 7/2003 |
| WO | 2005019429 | A2 | 3/2005 |
| WO | 2005044996 | A2 | 5/2005 |
| WO | 2005/118788 | A2 | 12/2005 |
| WO | 2006060878 | A1 | 6/2006 |
| WO | 2008045437 | A2 | 4/2008 |
| WO | 2009091826 | A2 | 7/2009 |
| WO | 2010085660 | A2 | 7/2010 |
| WO | 2011059836 | A2 | 5/2011 |
| WO | 2011097477 | A1 | 8/2011 |
| WO | 2012058460 | A2 | 5/2012 |
| WO | 2012079000 | A1 | 6/2012 |
| WO | 2012082841 | A2 | 6/2012 |
| WO | 2012/099973 | A2 | 7/2012 |
| WO | 2012127464 | A2 | 9/2012 |
| WO | 2012129514 | A1 | 9/2012 |
| WO | 2012135854 | A2 | 10/2012 |
| WO | 2012138858 | A1 | 10/2012 |
| WO | 2013019615 | A2 | 2/2013 |
| WO | 2013033626 | A2 | 3/2013 |
| WO | 2013040371 | A2 | 3/2013 |
| WO | 2013040557 | A2 | 3/2013 |
| WO | 2013059593 | A1 | 4/2013 |
| WO | 2013/126712 | A1 | 8/2013 |
| WO | 2013126729 | A1 | 8/2013 |
| WO | 2013126733 | A1 | 8/2013 |
| WO | 2014/011984 | A1 | 1/2014 |
| WO | 2014/011987 | A1 | 1/2014 |
| WO | 2014/011993 | A2 | 1/2014 |
| WO | 2014/012001 | A2 | 1/2014 |
| WO | 2014011988 | A2 | 1/2014 |
| WO | 2014011996 | A1 | 1/2014 |
| WO | 2014031687 | A1 | 2/2014 |
| WO | 2014039513 | A2 | 3/2014 |
| WO | 2014/055442 | A2 | 4/2014 |
| WO | 2014055657 | A1 | 4/2014 |
| WO | 2014130635 | A1 | 8/2014 |
| WO | 2014/145252 | A2 | 9/2014 |
| WO | 2015090229 | A1 | 6/2015 |
| WO | 2015090230 | A1 | 6/2015 |
| WO | 2015112626 | A1 | 7/2015 |
| WO | 2015/142661 | A1 | 9/2015 |
| WO | 2015142675 | A2 | 9/2015 |
| WO | 2015157252 | A1 | 10/2015 |

(56) References Cited

FOREIGN PATENT DOCUMENTS

| | | |
|---|---|---|
| WO | 2016014501 A1 | 1/2016 |
| WO | 2016014530 A1 | 1/2016 |
| WO | 2016014535 A1 | 1/2016 |
| WO | 2016014553 A1 | 1/2016 |
| WO | 2016014565 A2 | 1/2016 |
| WO | 2016014576 A1 | 1/2016 |
| WO | 2016019300 A1 | 2/2016 |
| WO | 2016025880 A1 | 2/2016 |
| WO | 2016028896 A1 | 2/2016 |
| WO | 2016044605 A1 | 3/2016 |
| WO | WO-2016203048 A1 * | 12/2016 ............... A61P 35/00 |

OTHER PUBLICATIONS

Watanabe et al, The Journal of Immunology, vol. 177, No. 2, Jul. 15, 2006 (Jul. 15, 2006), pp. 1085-1091. (Year: 2006).*
Fas et al, The Journal of Immunology, vol. 181, No. 3, Jul. 18, 2008 (Jul. 18, 2008), pp. 1969-1977. (Year: 2008).*
Ogawa et al. (International Immunology, vol. 25, No. 12, pp. 671-681, 2013). (Year: 2013).*
Boomer et al. (The Journal of Immunology, 2014, 192: 3465-3469). (Year: 2014).*
Kobold et al. (JNCI J Natl Cancer Inst (2015) 107(8): djv146). (Year: 2015).*
International Search Report and Written Opinion issued in PCT/US2018/015447, dated Apr. 10, 2018, 9 pages.
Harada et al., A Single Amino Acid Alteration in Cytoplasmic Domain Determines IL-2 Promoter Activation by Ligation of CD28 but Not Inducible Costimulator (ICOS) J Exp Med (2003) vol. 197, No. 2, pp. 257-262.
Watanabe et al., "Grb2 and Gads Exhibit Different Interactions with CD28 and Play Distinct Roles in CD28-Mediated Costimulation," J Immunol (2006) vol. 177, pp. 1085-1091.
Fos et al., "ICOS Ligation Recruits the p50alpha PI13K Regulatory Subunit to the Immunological Synapse," J Immunol (2008) vol. 181, pp. 1969-1977.
Van Der Stegen et al., "The pharmacology of second-generation chimeric antigen receptors," Nature Reviews Drug Discovery (2015) vol. 14, pp. 499-509.
Vettermann et al., "A signaling-enhanced chimeric reeptor to activate the ICOS pathway in T cells," Journal of Immunological Methods (2015) vol. 424, pp. 14-19.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses" Eur. J. Immunol. (1998) vol. 28 pp. 881-890.
Kochenderfer et al., "A Phase I Clinical Trial of Treatment of B-Cell Malignancies with Autologous Anti-Cd19-CAR-Transduced T Cells" BLOOD (2010) vol. 116 No. 21 pp. 1179-1180 & 52nd Annual Meeting of the American-Society-of-Hematology (ASH); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 689-702.
Kochenderfer et al., "Eradication of B-lineage cells and regression of lymphoma in a patient treated with autologous T cells genetically-engineered to recognize CD19," Blood 116: 4099-4102 (2010).
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.

Lamers et al., "Treatment of Metastatic Renal Cell Carcinoma With Autologous T-Lymphocytes Genetically Retargeted Against Carbonic Anhydrase IX: First Clinical Experience," J. Clin Oncol. 24(13): e20-e22 (2006).
Laport et al., "Adoptive transfer of costimulated T cells induces lymphocytosis in patients with relapsed/refractory non-Hodgkin lymphoma following CD34 +-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Macallan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
McGuinness et al., "Anti-tumor activity of human T cells expressing the CC49-zeta chimeric immune receptor," Hum. Gene Ther. 10: 165-173 (1999).
Milone et al., "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Molina, "A Decade of Rituximab: Improving Survival Outcomes in Non-Hodgkin's Lymphoma" Annu. Rev. Med. (2008) vol. 59 pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Park and Brentjens "Adoptive Immunotherapy for B-cell Malignancies with Autologous Chimeric Antigen Receptor Modified Tumor Targeted T Cells" Discovery Medicine (2010) vol. 9 No 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.

(56) References Cited

OTHER PUBLICATIONS

Porter et al., "Chimeric Antigen Receptor Therapy for B-cell Malignancies" Journal of Cancer (2011) vol. 2 pp. 331-332.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Rapoport et al., "Restoration of immunity in lymphopenic individuals with cancer by vaccination and adoptive T-cell transfer" Nature Medicine (2005) vol. 11 No. 11 pp. 1230-1237.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Shirasu et al., "Functional Design of Chimeric T-Cell Antigen Receptors for Adoptive Immunotherapy of Cancer Architecture and Outcomes," AntiCancer Res. 32: 2377-2384 (2012).
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Extended European Search Report issued in European Patent Application No. 21214015.6 dated Jul. 5, 2022, 6 pages.
Baeksgaard & Sorensen, "Acute tumor lysis syndrome in solid tumors—a case report and review of the literature" Cancer Chemotherapy Pharmacology (2003) vol. 51 pp. 187-192.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Novel cellular therapies for leukemia: CAR—modified T cells targeted to the CD19 antigen" Hematology (2012) pp. 143-151.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor—Chain alone Are Insufficient to Prime Resting T Lymphocytes" J. Exp Med. (1995) vol. 181 pp. 1653-1659.
Call & Wucherpfennig, "The T Cell Receptor: Critical Role of the Membrane Environment in Receptor Assembly and Function" Annu. Rev. Immunol. (2005) vol. 23 pp. 101-125.
Carpenito et al. "Control of large, established tumor xenografts with genetically retargeted human T cells containing CD28 and CD 137 domains". Proc Natl Acad Sci USA (2009) vol. 106 pp. 3360-3365.
Davila et al. "B Cell Aplasia in a Patient with Relapsed B Cell Acute Lymphoblastic Leukemia Following Re-Induction and Consolidation with Autologous T Cells Genetically Targeted to the CD 19 Antigen" 53rd ASH Annual Meeting and Exposition (2010) Oral and Poster Abstract.
Dohner et al., "P53 Gene Deletion Predicts for Poor Survival and Non-Response to Therapy With Purine Analogs in Chronic B-Cell Leukemias" Blood (1995) vol. 85 No. 6 pp. 1580-1589.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al, "A Third-Generation Lentivirus Vector with a Conditional Packaging System" Journal of Virology (1998) vol. 72 No. 11 pp. 8463-8471.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Finney et al., "Activation of resting human primary T cells with chimeric receptors: costimulation from CD28, inducible costimulator, CD 134, and CD 137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093(2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and costimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.

(56) References Cited

OTHER PUBLICATIONS

Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.

Gribben et al., "Stem cell transplantation for indolent lymphoma and chronic lymphocytic leukemia" Biol Blood Marrow Transplant (2011) vol. 17 (1 Suppl): S63-S70.

Griffin, "Development and applications of surface-linked single chain antibodies against T-cell antigens" Journal of Immunological Methods (2001) vol. 248 pp. 77-90.

Gross et al., "Endowing T cells with antibody specificity using chimeric T cell receptors," The FASEB Journal 6: 3370-3378 (1992).

Grupp et al. "Chimeric Antigen Receptor-Modified T Cells for Acute Lymphoid Leukemia", New England Journal of Medicine (2013) vol. 368 No. 16 pp. 1509-1518.

Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.

Hekele et al., "Growth Retardation of Tumors by Adoptive Transfer of Cytotoxic T Lymphocytes Reprogrammed by CD44V6-Specific SCFV:zeta-CHIMERA" Int J. Cancer (1996) vol. 68 pp. 232-238.

Ho et al., "Adoptive immunotherapy: Engineering T cell responses as biological weapons for tumor mass destruction" Cancer Cell (2003) vol. 3 pp. 431-437.

Hollyman et al. "Manufacturing validation of biologically functional T cells targeted to CD19 antigen for autologous adoptive cell therapy" J Immunother (2009) vol. 32 No. 2 pp. 169-180.

Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).

Imai et al., "Chimeric receptors with 4-1BB signaling capacity provoke potent cytotoxicity against acute lymphoblastic leukemia," Leukemia 18: 676-684 (2004).

Imai et al., "Genetic modification of primary natural killer cells overcomes inhibitory signals and induces specific killing of leukemic cells" Blood (2005) vol. 106 No. 1 pp. 376-383.

International Search Report from PCT/US2011/064191 dated Jan. 5, 2012.

Irving et al., "The cytoplasmic domain of the T cell receptor zeta chain is sufficient to couple to receptor-associated signal transduction pathways," Cell 64: 891-901 (1991).

Jena, Bipulendu et al. "Redirecting T-cell specificity by introducing a tumor-specific chimeric antigen receptor, Blood, May 3, 2010", vol. 116, No. 7, pp. 1035-1044.

Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.

Johnson et al., "Gene therapy with human and mouse T-cell receptors mediates cancer regression and targets normal tissues expressing cognate antigen" Blood (2009) vol. 114 No. 3 pp. 535-545.

June et al., "Engineering lymphocyte subsets: tools, trials and tribulations" Nat Rev Immunol (2009) vol. 9 No. 10 pp. 704-716.

Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.

\* cited by examiner

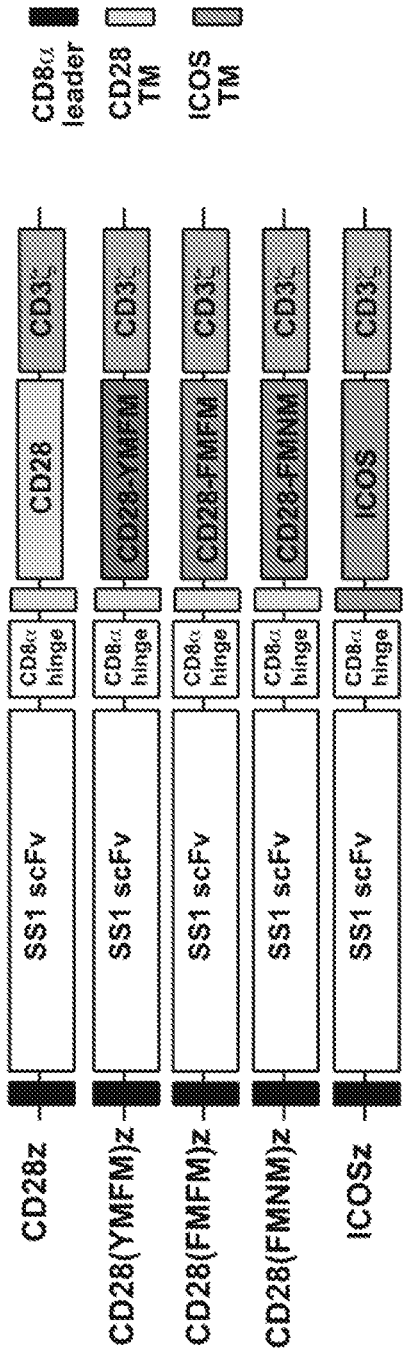

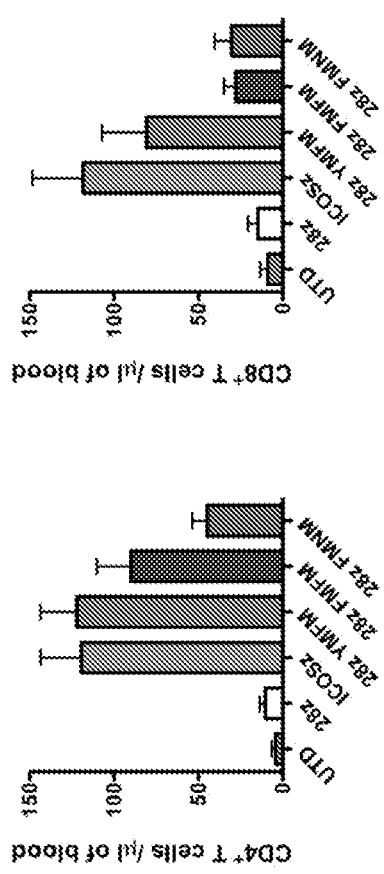
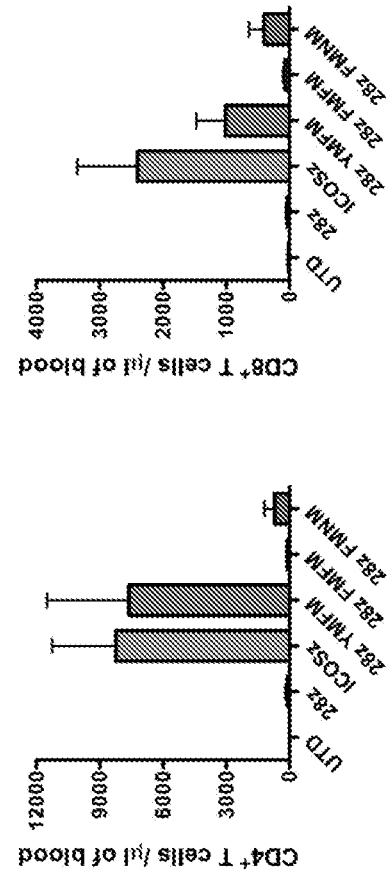
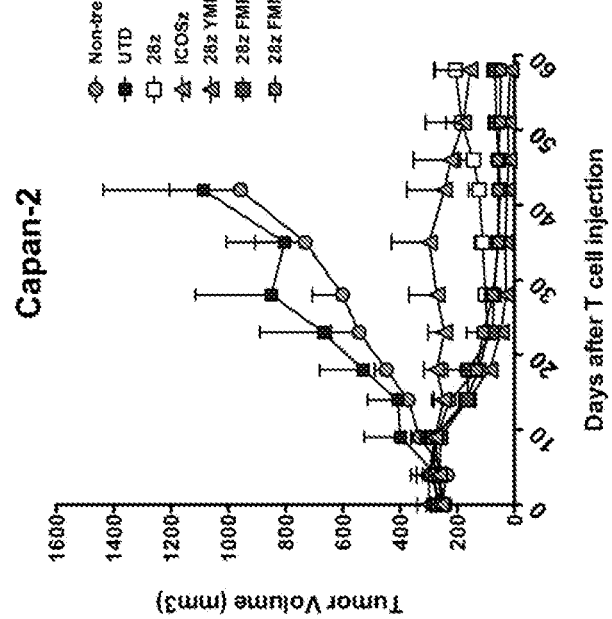
Fig. 3A
Fig. 3B
Fig. 3C

US 11,535,662 B2

CD28 COMPOSITIONS AND METHODS FOR CHIMERIC ANTIGEN RECEPTOR THERAPY

RELATED APPLICATIONS

This application is a U.S. national phase application and claims the benefit of priority under 35 U.S.C. § 371 of International Application No. PCT/US2018/015447, filed Jan. 26, 2018, which claims priority to U.S. Ser. No. 62/450,947 filed Jan. 26, 2017, the contents of each of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Jan. 26, 2018, is named N2067-7124WO-_SL.txt and is 1,023,927 bytes in size.

FIELD OF THE INVENTION

The present invention relates generally to the use of immune effector cells (e.g., T cells, NK cells) engineered to express a Chimeric Antigen Receptor (CAR) to treat a disease associated with expression of a tumor antigen.

BACKGROUND OF THE INVENTION

Adoptive cell transfer (ACT) therapy with autologous T-cells, especially with T-cells transduced with Chimeric Antigen Receptors (CARs), has shown promise in hematologic cancer trials.

SUMMARY OF THE INVENTION

The present invention pertains, at least in part, to the use of immune effector cells (e.g., T cells, NK cells) engineered to express a CAR polypeptide that binds to a tumor antigen as described herein to treat cancer associated with expression of said tumor antigen. In particular, the invention features such cells expressing a CAR polypeptide comprising a mutant CD28 costimulatory domain as described herein.

CAR-Encoding Nucleic Acids

Accordingly, in one aspect, the invention pertains to an isolated nucleic acid molecule encoding a chimeric antigen receptor (CAR) comprising a CD28 costimulatory domain, e.g., a mutant CD28 costimulatory domain, e.g., a mutant CD28 costimulatory domain described herein.

In one aspect, the invention pertains to an isolated nucleic acid molecule encoding a chimeric antigen receptor (CAR), wherein the CAR comprises i) an antigen binding domain, ii) a transmembrane domain, and iii) an intracellular signaling domain that comprises a costimulatory domain that comprises the amino acid sequence of RSKRSRLLHSDX$_1$MX$_2$MTPRRPGPTRKHYQPYAPPRD FAAYRS (SEQ ID NO: 1) or a sequence at least 90%, 95%, 97%, 98%, or 99% identical thereto, wherein the intracellular domain optionally further comprises a primary signaling domain, and wherein X$_1$ is any amino acid, and X$_2$ is any amino acid, provided that SEQ ID NO: 1 is not

RSKRSRLLHSDYMNMTPRRPGPTRKHYQPYAPPRDFAAYRS. (SEQ ID NO: 5)

In one aspect, the invention pertains to an isolated nucleic acid molecule encoding a chimeric antigen receptor (CAR), wherein the CAR comprises i) an antigen binding domain, ii) a transmembrane domain, and iii) an intracellular signaling domain that comprises a costimulatory domain that comprises the amino acid sequence of RSKRSRLLHSDX$_1$MX$_2$MTPRRPGPTRKHYQPYAPPRD FAAYRS (SEQ ID NO: 1) or a sequence at least 90%, 95%, 97%, 98%, or 99% identical thereto, wherein the intracellular domain optionally further comprises a primary signaling domain, and wherein X$_1$ is any amino acid, and X$_2$ is selected from R (Arg), C (Cys), E (Glu), G (Gly), H (His), I (Ile), L (Leu), M (Met), F (Phe), S (Ser), T (Thr), W (Trp), Y (Tyr), or V (Val), provided that SEQ ID NO: 1 is not RSKRSRLLHSDYMNMTPRRPGPTRKHYQPYAPPRD-FAAYRS (SEQ ID NO: 5).

In another aspect, the invention features a CAR molecule comprising: i) an antigen binding domain, ii) a transmembrane domain, and iii) an intracellular domain that comprises a costimulatory domain that comprises the amino acid sequence of SEQ ID NO: 1 or a sequence with no more than 1, 2, 3, or 4 modifications of the amino acid sequence of SEQ ID NO: 1, wherein the intracellular domain optionally further comprises a primary signaling domain, and wherein X$_1$ of SEQ ID NO: 1 is any amino acid, and X$_2$ of SEQ ID NO: 1 is any amino acid, provided that SEQ ID NO: 1 is not

RSKRSRLLHSDYMNMTPRRPGPTRKHYQPYAPPRDFAAYRS. (SEQ ID NO: 5)

In another aspect, the invention features a CAR molecule comprising: i) an antigen binding domain, ii) a transmembrane domain, and iii) an intracellular domain that comprises a costimulatory domain that comprises the amino acid sequence of SEQ ID NO: 1 or a sequence with no more than 1, 2, 3, or 4 modifications of the amino acid sequence of SEQ ID NO: 1, wherein the intracellular domain optionally further comprises a primary signaling domain, and wherein X$_1$ of SEQ ID NO: 1 is any amino acid, and X$_2$ of SEQ ID NO: 1 is selected from R (Arg), C (Cys), E (Glu), G (Gly), H (His), I (Ile), L (Leu), M (Met), F (Phe), S (Ser), T (Thr), W (Trp), Y (Tyr), or V (Val), provided that SEQ ID NO: 1 is not

RSKRSRLLHSDYMNMTPRRPGPTRKHYQPYAPPRDFAAYRS. (SEQ ID NO: 5)

In some embodiments, the encoded CAR molecule has reduced Grb2 binding compared to an otherwise similar CAR molecule comprising the wild-type CD28 amino acid sequence of SEQ ID NO: 5.

In some embodiments, the encoded CAR molecule has one or more (e.g., at least 2, 3, 4, 5, 6, 7, 8, 9, 10, 11, 12, 13, 14, or all) of the following properties:
  a) T cells comprising the CAR molecule produce a reduction in tumor load, e.g., assessed in an ASPC-1 flux assay, e.g., an assay of Example 3, e.g., a reduction in flux of at least about 2, 5, 10, 20, 50, or 100-fold, e.g., 12, 19, 26, 33, or 40 days after infusion of the T cells, e.g., compared to otherwise similar cells comprising a control CAR molecule, e.g., a control CAR molecule comprising the wild-type CD28 amino acid sequence of SEQ ID NO: 5;

b) T cells comprising the CAR molecule produce IL-2 at a level no less than about 95%, 90%, 80%, 70%, 60%, 50%, 40%, or 30% of that produced by otherwise similar cells comprising a control CAR molecule, e.g., a SS128z control CAR molecule or a control CAR molecule comprising the wild-type CD28 amino acid sequence of SEQ ID NO: 5, in an IL-2 release assay, e.g., an assay of Example 3;

c) T cells comprising the CAR molecule produce TNF-alpha at a level no less than about 95%, 90%, 80%, 70%, 60%, 50%, 40%, or 30%, of that produced by otherwise similar cells comprising a control CAR molecule, e.g., a SS128z control CAR molecule or a control CAR molecule comprising the wild-type CD28 amino acid sequence of SEQ ID NO: 5, in an TNF-alpha release assay, e.g., an assay of Example 3;

d) T cells comprising the CAR molecule produce IFN-gamma at a level no less than about 95%, 90%, 80%, 70%, 60%, 50%, 40%, or 30% of that produced by otherwise similar cells comprising a control CAR molecule, e.g., a SS128z control CAR molecule or a control CAR molecule comprising the wild-type CD28 amino acid sequence of SEQ ID NO: 5, in an IFN-gamma release assay, e.g., an assay of Example 3;

e) T cells comprising the CAR molecule produce GM-CSF at a level no less than about 95%, 90%, 80%, 70%, 60%, 50%, 40%, or 30% of that produced by otherwise similar cells comprising a control CAR molecule, e.g., a SS128z control CAR molecule or a control CAR molecule comprising the wild-type CD28 amino acid sequence of SEQ ID NO: 5, in an GM-CSF release assay, e.g., an assay of Example 3;

f) T cells comprising the CAR molecule produce a reduction in tumor volume of a least about 5%, 10%, 20%, 30%, 40%, 50%, 60%, 70%, 80%, or 90% compared to non-treated mice in a pancreatic tumor assay, e.g., as assay of Example 4;

g) T cells comprising the CAR molecule show a persistence of at least 50, 60, 70, 80, 90, 100, 120, or 130 CD4+ T cells/ul of blood, 30 days after administration, in a persistence assay, e.g., an assay of Example 4;

h) T cells comprising the CAR molecule show a persistence of at least 50, 60, 70, 80, 90, 100, 120, or 130 CD8+ T cells/ul of blood, 30 days after administration, in a persistence assay, e.g., an assay of Example 4;

i) T cells comprising the CAR molecule show a persistence of at least 3000, 4000, 5000, 6000, or 7000 CD4+ T cells/ul of blood, 60 days after administration, in a persistence assay, e.g., an assay of Example 4;

j) T cells comprising the CAR molecule show a persistence of at least 600, 800, 1000, or 1200 CD8+ T cells/ul of blood, 60 days after administration, in a persistence assay, e.g., an assay of Example 4;

k) T cells comprising the CAR molecule show a reduction in calcium flux, e.g., a reduction in flux of at least 10%, 20%, 30%, 40%, 50%, or 60%, compared to otherwise similar cells comprising a control CAR molecule, e.g., a control CAR molecule comprising the wild-type CD28 amino acid sequence of SEQ ID NO: 5, e.g., as assessed in an assay of Example 5;

l) T cells comprising the CAR molecule produce ROS at a level no more than 40%, 50%, 60%, 70%, or 80% of that produced by otherwise similar cells comprising a control CAR molecule, e.g., a control CAR molecule comprising the wild-type CD28 amino acid sequence of SEQ ID NO: 5, e.g., after 3, 4, or 5 days of stimulation, e.g., as assessed in an assay of Example 6;

m) T cells comprising the CAR molecule show a reduction in expression, e.g., transcription, of an exhaustion marker, e.g., Tox2, e.g., a reduction of at least 30%, 40%, 50%, or 60%, compared to otherwise similar cells comprising a control CAR molecule, e.g., a control CAR molecule comprising the wild-type CD28 amino acid sequence of SEQ ID NO: 5, e.g., after 3, 4, 5, 6, 7, 8, or 9 days of stimulation, e.g., as assessed in an assay of Example 6;

n) T cells comprising the CAR molecule show a reduction in phosphorylation of Vav, PLCγ, or ERK, e.g., a reduction of at least 10%, 20%, 30%, 40%, 50%, or 60%, compared to otherwise similar cells comprising a control CAR molecule, e.g., a control CAR molecule comprising the wild-type CD28 amino acid sequence of SEQ ID NO: 5, e.g., after 4, 5, 6, 7, 8, 9, 10, or 11 minutes of stimulation, e.g., as assessed in an assay of Example 7; or o) T cells comprising the CAR molecule show an increase in phosphorylation of AKT, e.g., an increase of at least 30%, 60%, 100%, 150%, or 200%, compared to otherwise similar cells comprising a control CAR molecule, e.g., a control CAR molecule comprising the wild-type CD28 amino acid sequence of SEQ ID NO: 5, e.g., after 4, 5, 6, 7, 8, 9, 10, or 11 minutes of stimulation, e.g., as assessed in an assay of Example 7.

In some embodiments, the encoded CAR molecule has one or more (e.g., at least 2, 3, or all) of the following properties:

a) the CAR molecule binds PI3-kinase, e.g., with at least about the same affinity as an otherwise similar CAR molecule comprising the wild-type CD28 amino acid sequence of SEQ ID NO: 5 binds to PI3-kinase;

b) the CAR molecule mediates costimulation, e.g., to at least about the same extent as an otherwise similar CAR molecule comprising the wild-type CD28 amino acid sequence of SEQ ID NO: 5;

c) the CAR molecule promotes T cell activation, e.g., to at least about the same extent as an otherwise similar CAR molecule comprising the wild-type CD28 amino acid sequence of SEQ ID NO: 5; or d) the CAR molecule promotes IL-2 secretion, e.g., by at least about the same amount as an otherwise similar CAR molecule comprising the wild-type CD28 amino acid sequence of SEQ ID NO: 5.

In some embodiments, $X_1$ is an amino acid that is a conservative amino acid substitution relative to the same position in SEQ ID NO: 5.

In some embodiments, $X_1$ is an amino acid selected from Y (Tyr), F (Phe), and W (Trp).

In some embodiments, $X_2$ is F (Phe).

In some embodiments, $X_1$ is Y (Tyr).

In some embodiments, $X_1$ is Y (Tyr) and $X_2$ is F (Phe).

In some embodiments, the encoded CAR molecule comprises the amino acid sequence RSKRSRLLHSDYMFMT-PRRPGPTRKHYQPYAPPRDFAAYRS (SEQ ID NO: 2).

In some embodiments, the encoded CAR molecule comprises the amino acid sequence RSKRSRLLHSDFMNMT-PRRPGPTRKHYQPYAPPRDFAAYRS (SEQ ID NO: 3).

In some embodiments, the encoded CAR molecule comprises the amino acid sequence RSKRSRLLHSDFMFMT-PRRPGPTRKHYQPYAPPRDFAAYRS (SEQ ID NO: 4).

In some embodiments, if $X_1$ is Y (Tyr) then $X_2$ is not N (Asn), and/or if $X_2$ is N (Asn) then $X_1$ is not Y (Tyr). In some embodiments, SEQ ID NO:1 does not comprise $X_1$=Y (Tyr) and $X_2$=N (Asn).

In some embodiments, the encoded CAR molecule comprises a primary signaling domain.

In certain embodiments, the encoded primary signaling domain comprises a functional signaling domain of a protein selected from the group consisting of CD3 zeta, CD3 gamma, CD3 delta, CD3 epsilon, common FcR gamma (FCER1G), FcR beta (Fc Epsilon R1b), CD79a, CD79b, Fcgamma RIIa, DAP10, and DAP12, or a functional variant thereof.

In one embodiment, the encoded primary signaling domain comprises a functional signaling domain of CD3 zeta, or a functional variant thereof. The encoded CD3 zeta primary signaling domain can comprise an amino acid sequence having at least one, two or three modifications but not more than 20, 10 or 5 modifications of the amino acid sequence of SEQ ID NO: 18 or SEQ ID NO: 20, or a sequence with at least 95-99% identity to the amino acid sequence of SEQ ID NO:18 or SEQ ID NO: 20. In some embodiments, the encoded primary signaling domain comprises a sequence of SEQ ID NO:18 or SEQ ID NO: 20. In other embodiments, the nucleic acid sequence encoding the primary signaling domain comprises a sequence of SEQ ID NO:19 or SEQ ID NO: 21, or a sequence with at least 95-99% identity thereof.

In some embodiments, the intracellular signaling domain of the encoded CAR polypeptide molecule comprises a second costimulatory signaling domain. For example, the intracellular signaling domain can comprise a sequence encoding a primary signaling domain, a first costimulatory domain comprising a mutant CD28 sequence, e.g., a sequence selected from SEQ ID NOs: 1-4, as described herein, and a sequence encoding a second costimulatory signaling domain. In some embodiments, the encoded second costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CD5, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D, or a functional variant thereof.

In some embodiments, the antigen binding domain binds a tumor antigen.

In some embodiments, the tumor antigen is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bDGalp(1-4)bDGicp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4)bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B 1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRLS); and immunoglobulin lambda-like polypeptide 1 (IGLL1).

In some embodiments, tumor antigen bound by the encoded CAR molecule is chosen from one or more of: TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, Fucosyl GM1, sLe, GM3, TGS5, HMWMAA, o-acetyl-GD2, Folate receptor beta, TEM1/CD248, TEM7R, CLDN6, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRLS, and IGLL1.

In certain embodiments, the tumor antigen bound by the encoded CAR molecule is chosen from one or more of: TSHR, CLDN6, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, CD150, 5T4, ActRIIA, B7, BMCA, CA-125, CCNA1, CD123, CD126, CD138, CD14, CD148, CD15, CD19, CD20, CD200, CD21, CD22, CD23, CD24, CD25, CD26, CD261, CD262, CD30, CD33, CD362, CD37, CD38, CD4, CD40, CD40L, CD44, CD46, CD5, CD52, CD53, CD54, CD56, CD66a-d, CD74, CD8, CD80, CD92, CE7, CS-1, CSPG4, ED-B fibronectin, EGFR, EGFRvIII, EGP-2, EGP-4, EPHa2, ErbB2, ErbB3, ErbB4, FBP, GD2, GD3, HER1-HER2 in combination, HER2-HER3 in combination, HERV-K, HIV-1 envelope glycoprotein gp120, HIV-1 envelope glycoprotein gp41, HLA-DR, HM1.24, HMW-MAA, Her2, Her2/neu, IGF-1R, IL-11Ralpha, IL-13R-alpha2, IL-2, IL-22R-alpha, IL-6, IL-6R, Ia, Ii, L1-CAM, L1-cell adhesion molecule, Lewis Y, L1-CAM, MAGE A3, MAGE-A1, MART-1, MUC1, NKG2C ligands, NKG2D Ligands, NY-ESO-1, OEPHa2, PIGF, PSCA, PSMA, ROR1, T101, TAC, TAG72, TIM-3, TRAIL-R1, TRAIL-R1 (DR4), TRAIL-R2 (DR5), VEGF, VEGFR2, WT-1, a G-protein coupled receptor, alphafetoprotein (AFP), an angiogenesis factor, an exogenous cognate binding molecule (ExoCBM), oncogene product, anti-folate receptor, c-Met, carcinoembryonic antigen (CEA), cyclin (D1), ephrinB2, epithelial tumor antigen, estrogen receptor, fetal acethycholine e receptor, folate binding protein, gp100, hepatitis B surface antigen, kappa chain, kappa light chain, kdr, lambda chain, livin, melanoma-associated antigen, mesothelin, mouse double minute 2 homolog (MDM2), mucin 16 (MUC16), mutated p53, mutated ras, necrosis antigens, oncofetal antigen, ROR2, progesterone receptor, prostate specific antigen, tEGFR, tenascin, β2-Microglobulin, Fc Receptor-like 5 (FcRL5), or molecules expressed by HIV, HCV, HBV, or other pathogens.

In some embodiments, the antigen binding domain of the encoded CAR molecule comprises an antibody, an antibody fragment, an scFv, a Fv, a Fab, a (Fab')2, a single domain antibody (SDAB), a VH or VL domain, or a camelid VHH domain.

In some embodiments, the transmembrane domain of the encoded CAR molecule comprises a transmembrane domain chosen from the transmembrane domain of an alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C, or a functional variant thereof.

In some embodiments, the encoded transmembrane domain comprises a transmembrane domain of CD28, e.g., IYIWAPLAGTCGVLLLSLVITLYC (SEQ ID NO: 12).

In certain embodiments, the encoded transmembrane domain comprises an amino acid sequence of a CD8 transmembrane domain having at least one, two or three modifications but not more than 20, 10 or 5 modifications of the amino acid sequence of SEQ ID NO: 12, or a sequence with at least 95-99% identity to the amino acid sequence of SEQ ID NO: 12. In one embodiment, the encoded transmembrane domain comprises the sequence of SEQ ID NO: 12.

In other embodiments, the nucleic acid molecule comprises a nucleotide sequence of a CD8 transmembrane domain, e.g., comprising the sequence of SEQ ID NO: 13, or a sequence with at least 95-99% identity thereof.

In certain embodiments, the encoded antigen binding domain is connected to the transmembrane domain by a hinge region. In one embodiment, the encoded hinge region comprises the amino acid sequence of a CD8 hinge, e.g., SEQ ID NO: 403; or the amino acid sequence of an IgG4 hinge, e.g., SEQ ID NO: 405, or a sequence with at least 95-99% identity to SEQ ID NO:403 or 405. In other embodiments, the nucleic acid sequence encoding the hinge region comprises a sequence of SEQ ID NO: 404 or SEQ ID NO: 406, corresponding to a CD8 hinge or an IgG4 hinge, respectively, or a sequence with at least 95-99% identity to SEQ ID NO:404 or 406.

In certain embodiments, the chimeric antigen receptor comprises a leader region, wherein said leader region encodes an amino acid sequence comprising SEQ ID NO: 401, or a sequence with at least 95-99% identity thereof; or said leader region comprises the nucleotide sequence of SEQ ID NO: 402, or a nucleotide sequence with at least 95-99% identity thereof.

In other embodiments, the CAR molecule comprises: i) an antigen binding domain, ii) a transmembrane domain, and iii) an intracellular domain that comprises a costimulatory domain that comprises the amino acid sequence of RSKRSRLLHSDYMFMTPRRPGPTRKHYQPYAPPRD-
FAAYRS (SEQ ID NO: 2), wherein the intracellular domain further comprises a primary signaling domain.

In some embodiments, the encoded intracellular signaling domain comprises a sequence encoding a second costimulatory signaling domain. For example, the intracellular signaling domain can comprise a sequence encoding a primary signaling domain, a sequence encoding a first costimulatory domain comprising a sequence selected from SEQ ID NOs: 1-4, as described herein, and a sequence encoding a second costimulatory signaling domain. In some embodiments, the encoded second costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CD5, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D, or a functional variant thereof.

In certain embodiments, the encoded costimulatory signaling domain comprises an amino acid sequence having at least one, two or three modifications but not more than 20, 10 or 5 modifications of the amino acid sequence of SEQ ID NOs:1-5, or a sequence with at least 95-99% identity to the amino acid sequence of SEQ ID NO:1-5. In one embodiment, the encoded costimulatory signaling domain comprises a sequence of SEQ ID NOs: 1-5. In other embodiments, the nucleic acid sequence encoding the costimulatory signaling domain comprises a sequence selected from SEQ ID NOs:7-9, or a sequence with at least 95-99% identity thereof.

In other embodiments, the encoded intracellular domain comprises the sequence of SEQ ID NO: 1-5, and the sequence of SEQ ID NO: 18 or SEQ ID NO: 20, wherein the sequences comprising the intracellular signaling domain are expressed in the same frame and as a single polypeptide chain.

In certain embodiments, the nucleic acid sequence encoding the intracellular signaling domain comprises a sequence selected from SEQ ID NOs:7-9, or a sequence with at least 95-99% identity thereof, and a sequence of SEQ ID NO:19 or SEQ ID NO:21, or a sequence with at least 95-99% identity thereof.

In some embodiments, the nucleic acid molecule further comprises a leader sequence. In one embodiment, the leader sequence comprises the sequence of SEQ ID NO: 402.

In certain embodiments, the encoded antigen binding domain has a binding affinity KD of $10^{-4}$ M to $10^{-8}$ M.

In one embodiment, the encoded antigen binding domain is an antigen binding domain described herein, e.g., an antigen binding domain described herein for a target provided above.

In one embodiment, the encoded CAR molecule comprises an antigen binding domain that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the antigen binding domain has a binding affinity that is at least five-fold, 10-fold, 20-fold, 30-fold, 50-fold, 100-fold or 1,000-fold less than a reference antibody, e.g., an antibody described herein. In one embodiment, the encoded antigen binding domain has a binding affinity at least 5-fold less than a reference antibody (e.g., an antibody from which the antigen binding domain is derived).

In one aspect, the invention pertains to an isolated nucleic acid molecule encoding a chimeric antigen receptor (CAR), wherein the CAR comprises an antigen binding domain (e.g., antibody or antibody fragment, TCR or TCR fragment) that binds to a tumor-supporting antigen (e.g., a tumor-supporting antigen as described herein), a transmembrane domain (e.g., a transmembrane domain described herein), and an intracellular signaling domain (e.g., an intracellular signaling domain described herein) (e.g., an intracellular signaling domain comprising a costimulatory domain (e.g., a costimulatory domain described herein) and/or a primary signaling domain (e.g., a primary signaling domain described herein). In some embodiments, the tumor-supporting antigen is an antigen present on a stromal cell or a myeloid-derived suppressor cell (MDSC).

In some embodiments, the invention pertains to an isolated nucleic acid encoding a chimeric antigen receptor (CAR) molecule comprising: i) an antigen binding domain, ii) a transmembrane domain, and iii) an intracellular signaling domain that comprises a costimulatory domain that comprises the amino acid sequence of (SEQ ID NO: 1)
RSKRSRLLHSDX$_1$MX$_2$MTPRRPGPTRKHYQPYAPPRDFAAYRS, wherein X$_1$ is any amino acid, and X$_2$ is any amino acid, provided that SEQ ID NO: 1 is not RSKRSRLLHSDYMNMTPRRPGPTRKHYQPYAPPRD-FAAYRS (SEQ ID NO: 5). In an embodiment, X$_1$ is F (Phe), and X$_2$ is any amino acid. In an embodiment, X$_1$ is Y (Tyr), and X$_2$ is any amino acid. In an embodiment, X$_1$ is any amino acid, and X$_2$ is F (Phe). In an embodiment, X$_1$ is any amino acid, and X$_2$ is N (Asn).

Vectors

In another aspect, the invention pertains to a vector comprising a nucleic acid sequence encoding a CAR polypeptide described herein. In one embodiment, the vector is chosen from a DNA vector, an RNA vector, a plasmid, a lentivirus vector, adenoviral vector, or a retrovirus vector. In one embodiment, the vector is a lentivirus vector.

In an embodiment, the vector comprises a nucleic acid sequence that encodes a CAR, e.g., a CAR described herein, and a nucleic acid sequence that encodes an inhibitory molecule comprising: an inhKIR cytoplasmic domain; a transmembrane domain, e.g., a KIR transmembrane domain; and an inhibitor cytoplasmic domain, e.g., an ITIM domain, e.g., an inhKIR ITIM domain. In an embodiment the inhibitory molecule is a naturally occurring inhKIR, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring inhKIR.

In an embodiment, the nucleic acid sequence that encodes an inhibitory molecule comprises: a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In an embodiment the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

In one embodiment, the vector further comprises a promoter. In some embodiments, the promoter is chosen from an EF-1 promoter, a CMV IE gene promoter, an EF-1α promoter, an ubiquitin C promoter, or a phosphoglycerate kinase (PGK) promoter. In one embodiment, the promoter is an EF-1 promoter. In one embodiment, the EF-1 promoter comprises a sequence of SEQ ID NO: 400.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail described herein, e.g., comprising about 150 adenosine bases (SEQ ID NO:33). In one embodiment, the nucleic acid sequence in the vector further comprises a 3'UTR, e.g., a 3' UTR described herein, e.g., comprising at least one repeat of a 3'UTR derived from human beta-globulin. In one embodiment, the nucleic acid sequence in the vector further comprises promoter, e.g., a T2A promoter.

CAR Polypeptides

In one aspect, the invention pertains to a chimeric antigen receptor (CAR) comprising a CD28 costimulatory domain, e.g., a mutant CD28 costimulatory domain, e.g., a mutant CD28 costimulatory domain described herein.

In one aspect, the invention pertains to a chimeric antigen receptor (CAR), wherein the CAR comprises i) an antigen binding domain, ii) a transmembrane domain, and iii) an intracellular signaling domain that comprises a costimulatory domain that comprises the amino acid sequence of RSKRSRLLHSDX$_1$MX$_2$MTPRRPGPTRKHYQPYAPPRDFAAYRS (SEQ ID NO: 1) or a sequence at least 90%, 95%, 97%, 98%, or 99% identical thereto, wherein the intracellular domain optionally further comprises a primary signaling domain, and wherein X$_1$ is any amino acid, and X$_2$ is any amino acid, provided that SEQ ID NO: 1 is not (SEQ ID NO: 5)
RSKRSRLLHSDYMNMTPRRPGPTRKHYQPYAPPRDFAAYRS.

In another aspect, the invention features a chimeric antigen receptor (CAR) molecule comprising: i) an antigen binding domain, ii) a transmembrane domain, and iii) an intracellular signaling domain that comprises a costimulatory domain that comprises the amino acid sequence of RSKRSRLLHSDX$_1$MX$_2$MTPRRPGPTRKHYQPYAPPRDFAAYRS (SEQ ID NO: 1) or a sequence at least 90%, 95%, 97%, 98%, or 99% identical thereto, wherein the intracellular domain optionally further comprises a primary signaling domain, and wherein X$_1$ is any amino acid, and X$_2$ is selected from R (Arg), C (Cys), E (Glu), G (Gly), H (His), I (Ile), L (Leu), M (Met), F (Phe), S (Ser), T (Thr), W (Trp), Y (Tyr), or V (Val), provided that SEQ ID NO: 1 is not RSKRSRLLHSDYMNMTPRRPGPTRKHYQPYAPPRD-FAAYRS (SEQ ID NO: 5).

In another aspect, the invention features a CAR molecule comprising: i) an antigen binding domain, ii) a transmembrane domain, and iii) an intracellular domain that comprises a costimulatory domain that comprises the amino acid sequence of SEQ ID NO: 1 or a sequence with no more than 1, 2, 3, or 4 modifications of the amino acid sequence of SEQ ID NO: 1, wherein the intracellular domain optionally further comprises a primary signaling domain, and wherein X$_1$ of SEQ ID NO: 1 is any amino acid, and X$_2$ of SEQ ID NO: 1 is any amino acid, provided that SEQ ID NO: 1 is not (SEQ ID NO: 5)
RSKRSRLLHSDYMNMTPRRPGPTRKHYQPYAPPRDFAAYRS.

In another aspect, the invention features a CAR molecule comprising: i) an antigen binding domain, ii) a transmembrane domain, and iii) an intracellular domain that comprises a costimulatory domain that comprises the amino acid sequence of SEQ ID NO: 1 or a sequence with no more than 1, 2, 3, or 4 modifications of the amino acid sequence of SEQ ID NO: 1, wherein the intracellular domain optionally further comprises a primary signaling domain, and wherein X$_1$ of SEQ ID NO: 1 is any amino acid, and X$_2$ of SEQ ID NO: 1 is selected from R (Arg), C (Cys), E (Glu), G (Gly), H (His), I (Ile), L (Leu), M (Met), F (Phe), S (Ser), T (Thr), W (Trp), Y (Tyr), or V (Val), provided that SEQ ID NO: 1 is not (SEQ ID NO: 5)
RSKRSRLLHSDYMNMTPRRPGPTRKHYQPYAPPRDFAAYRS.

In some embodiments, the CAR molecule has reduced Grb2 binding compared to an otherwise similar CAR molecule comprising the wild-type CD28 amino acid sequence of SEQ ID NO: 5.

In some embodiments, the CAR molecule has one or more (e.g., at least 2, 3, 4, 5, 6, 7, 8, 9, 10, 11, 12, 13, 14, or all) of the following properties:
  a) T cells comprising the CAR molecule produce a reduction in tumor load, e.g., assessed in an ASPC-1 flux assay, e.g., an assay of Example 3, e.g., a reduction in flux of at least about 2, 5, 10, 20, 50, or 100-fold, e.g., 12, 19, 26, 33, or 40 days after infusion of the T cells, e.g., compared to otherwise similar cells comprising a control CAR molecule, e.g., a control CAR molecule comprising the wild-type CD28 amino acid sequence of SEQ ID NO: 5;
  b) T cells comprising the CAR molecule produce IL-2 at a level no less than about 95%, 90%, 80%, 70%, 60%, 50%, 40%, or 30% of that produced by otherwise similar cells comprising a control CAR molecule, e.g., a SS128z control CAR molecule or a control CAR molecule comprising the wild-type CD28 amino acid sequence of SEQ ID NO: 5, in an IL-2 release assay, e.g., an assay of Example 3;
  c) T cells comprising the CAR molecule produce TNF-alpha at a level no less than about 95%, 90%, 80%, 70%, 60%, 50%, 40%, or 30%, of that produced by otherwise similar cells comprising a control CAR molecule, e.g., a SS128z control CAR molecule or a control CAR molecule comprising the wild-type CD28 amino acid sequence of SEQ ID NO: 5, in an TNF-alpha release assay, e.g., an assay of Example 3;
  d) T cells comprising the CAR molecule produce IFN-gamma at a level no less than about 95%, 90%, 80%, 70%, 60%, 50%, 40%, or 30% of that produced by otherwise similar cells comprising a control CAR molecule, e.g., a SS128z control CAR molecule or a control CAR molecule comprising the wild-type CD28 amino acid sequence of SEQ ID NO: 5, in an IFN-gamma release assay, e.g., an assay of Example 3;
  e) T cells comprising the CAR molecule produce GM-CSF at a level no less than about 95%, 90%, 80%, 70%, 60%, 50%, 40%, or 30% of that produced by otherwise similar cells comprising a control CAR molecule, e.g., a SS128z control CAR molecule or a control CAR molecule comprising the wild-type CD28 amino acid sequence of SEQ ID NO: 5, in an GM-CSF release assay, e.g., an assay of Example 3;

f) T cells comprising the CAR molecule produce a reduction in tumor volume of a least about 5%, 10%, 20%, 30%, 40%, 50%, 60%, 70%, 80%, or 90% compared to non-treated mice in a pancreatic tumor assay, e.g., as assay of Example 4;

g) T cells comprising the CAR molecule show a persistence of at least 50, 60, 70, 80, 90, 100, 120, or 130 CD4+ T cells/ul of blood, 30 days after administration, in a persistence assay, e.g., an assay of Example 4;

h) T cells comprising the CAR molecule show a persistence of at least 50, 60, 70, 80, 90, 100, 120, or 130 CD8+ T cells/ul of blood, 30 days after administration, in a persistence assay, e.g., an assay of Example 4;

i) T cells comprising the CAR molecule show a persistence of at least 3000, 4000, 5000, 6000, or 7000 CD4+ T cells/ul of blood, 60 days after administration, in a persistence assay, e.g., an assay of Example 4;

j) T cells comprising the CAR molecule show a persistence of at least 600, 800, 1000, or 1200 CD8+ T cells/ul of blood, 60 days after administration, in a persistence assay, e.g., an assay of Example 4;

k) T cells comprising the CAR molecule show a reduction in calcium flux, e.g., a reduction in flux of at least 10%, 20%, 30%, 40%, 50%, or 60%, compared to otherwise similar cells comprising a control CAR molecule, e.g., a control CAR molecule comprising the wild-type CD28 amino acid sequence of SEQ ID NO: 5, e.g., as assessed in an assay of Example 5;

l) T cells comprising the CAR molecule produce ROS at a level no more than 40%, 50%, 60%, 70%, or 80% of that produced by otherwise similar cells comprising a control CAR molecule, e.g., a control CAR molecule comprising the wild-type CD28 amino acid sequence of SEQ ID NO: 5, e.g., after 3, 4, or 5 days of stimulation, e.g., as assessed in an assay of Example 6;

m) T cells comprising the CAR molecule show a reduction in expression, e.g., transcription, of an exhaustion marker, e.g., Tox2, e.g., a reduction of at least 30%, 40%, 50%, or 60%, compared to otherwise similar cells comprising a control CAR molecule, e.g., a control CAR molecule comprising the wild-type CD28 amino acid sequence of SEQ ID NO: 5, e.g., after 3, 4, 5, 6, 7, 8, or 9 days of stimulation, e.g., as assessed in an assay of Example 6;

n) T cells comprising the CAR molecule show a reduction in phosphorylation of Vav, PLCγ, or ERK, e.g., a reduction of at least 10%, 20%, 30%, 40%, 50%, or 60%, compared to otherwise similar cells comprising a control CAR molecule, e.g., a control CAR molecule comprising the wild-type CD28 amino acid sequence of SEQ ID NO: 5, e.g., after 4, 5, 6, 7, 8, 9, 10, or 11 minutes of stimulation, e.g., as assessed in an assay of Example 7; or o) T cells comprising the CAR molecule show an increase in phosphorylation of AKT, e.g., an increase of at least 30%, 60%, 100%, 150%, or 200%, compared to otherwise similar cells comprising a control CAR molecule, e.g., a control CAR molecule comprising the wild-type CD28 amino acid sequence of SEQ ID NO: 5, e.g., after 4, 5, 6, 7, 8, 9, 10, or 11 minutes of stimulation, e.g., as assessed in an assay of Example 7.

In some embodiments, the CAR molecule has one or more (e.g., at least 2, 3, or all) of the following properties:

a) the CAR molecule binds PI3-kinase, e.g., with at least about the same affinity as an otherwise similar CAR molecule comprising the wild-type CD28 amino acid sequence of SEQ ID NO: 5 binds to PI3-kinase;

b) the CAR molecule mediates costimulation, e.g., to at least about the same extent as an otherwise similar CAR molecule comprising the wild-type CD28 amino acid sequence of SEQ ID NO: 5;

c) the CAR molecule promotes T cell activation, e.g., to at least about the same extent as an otherwise similar CAR molecule comprising the wild-type CD28 amino acid sequence of SEQ ID NO: 5; or d) the CAR molecule promotes IL-2 secretion, e.g., by at least about the same amount as an otherwise similar CAR molecule comprising the wild-type CD28 amino acid sequence of SEQ ID NO: 5.

In some embodiments, $X_1$ is an amino acid that is a conservative amino acid substitution relative to the same position in SEQ ID NO: 5.

In some embodiments, $X_1$ is an amino acid selected from Y (Tyr), F (Phe), and W (Trp).

In some embodiments, $X_2$ is F (Phe).

In some embodiments, $X_1$ is Y (Tyr).

In some embodiments, $X_1$ is Y (Tyr) and $X_2$ is F (Phe).

In some embodiments, the CAR molecule comprises the amino acid sequence

```
                                             (SEQ ID NO: 2)
RSKRSRLLHSDYMFMTPRRPGPTRKHYQPYAPPRDFAAYRS.
```

In some embodiments, the CAR molecule comprises the amino acid sequence

```
                                             (SEQ ID NO: 3)
RSKRSRLLHSDFMNMTPRRPGPTRKHYQPYAPPRDFAAYRS.
```

In some embodiments, the CAR molecule comprises the amino acid sequence

```
                                             (SEQ ID NO: 4)
RSKRSRLLHSDFMFMTPRRPGPTRKHYQPYAPPRDFAAYRS.
```

In some embodiments, the CAR molecule comprises a primary signaling domain. In other embodiments, the primary signaling domain of the CAR polypeptide molecule comprises a functional signaling domain of a protein selected from the group consisting of CD3 zeta, CD3 gamma, CD3 delta, CD3 epsilon, common FcR gamma (FCER1G), FcR beta (Fc Epsilon R1b), CD79a, CD79b, Fcgamma RIIa, DAP10, and DAP12, or a functional variant thereof. In one embodiment, the primary signaling domain comprises a functional signaling domain of CD3 zeta, or a functional variant thereof. In one embodiment, the primary signaling domain comprises a functional signaling domain of CD3 zeta. The CD3 zeta primary signaling domain can comprise an amino acid sequence having at least one, two or three modifications but not more than 20, 10 or 5 modifications of the amino acid sequence of SEQ ID NO: 18 or SEQ ID NO: 20, or a sequence with at least 95-99% identity to the amino acid sequence of SEQ ID NO:18 or SEQ ID NO: 20. In some embodiments, the primary signaling domain of the CAR polypeptide molecule comprises a sequence of SEQ ID NO:18 or SEQ ID NO: 20. In some embodiments, the intracellular signaling domain of the CAR polypeptide molecule comprises a second costimulatory signaling domain. For example, the intracellular signaling domain can comprise a primary signaling domain, a first costimulatory domain comprising a sequence selected from SEQ ID NOs: 1-4, as described herein, and a second costimulatory signaling domain. In some embodiments, the second costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CD5, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D, or a functional variant thereof.

In some embodiments, the antigen binding domain binds a tumor antigen.

In some embodiments, the tumor antigen is chosen from one or more of: CD19, CD123, CD22, CD30, CD171, CS-1, CLL-1 (CLECL1), CD33, EGFRvIII, GD2, GD3, BCMA, Tn Ag, PSMA, ROR1, FLT3, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, FAP, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, legumain, HPV E6,E7, intestinal carboxyl esterase, mut hsp70-2, CD79a, CD79b, CD72, LAIR1, FCAR, LILRA2, CD300LF, CLEC12A, BST2, EMR2, LY75, GPC3, FCRLS, and IGLL1.

In some embodiments, the antigen binding domain of the CAR polypeptide molecule binds to a tumor antigen chosen from one or more of: TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, Fucosyl GM1, sLe, GM3, TGS5, HMWMAA, o-acetyl-GD2, Folate receptor beta, TEM1/CD248, TEM7R, CLDN6, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRLS, and IGLL1.

In some embodiments, the antigen binding domain of the CAR polypeptide molecule binds to a tumor antigen chosen from one or more of: TSHR, CLDN6, GPRCSD, CXORF61, CD97, CD179a, ALK, polysialic acid, PLAC1, GloboH, NY-BR-1, UPK2, HAVCR1, ADRB3, PANX3, GPR20, LY6K, OR51E2, CD150, 5T4, ActRIIA, B7, BMCA, CA-125, CCNA1, CD123, CD126, CD138, CD14, CD148, CD15, CD19, CD20, CD200, CD21, CD22, CD23, CD24, CD25, CD26, CD261, CD262, CD30, CD33, CD362, CD37, CD38, CD4, CD40, CD40L, CD44, CD46, CD5, CD52, CD53, CD54, CD56, CD66a-d, CD74, CD8, CD80, CD92, CE7, CS-1, CSPG4, ED-B fibronectin, EGFR, EGFRvIII, EGP-2, EGP-4, EPHa2, ErbB2, ErbB3, ErbB4, FBP, GD2, GD3, HER1-HER2 in combination, HER2-HER3 in combination, HERV-K, HIV-1 envelope glycoprotein gp120, HIV-1 envelope glycoprotein gp41, HLA-DR, HM1.24, HMW-MAA, Her2, Her2/neu, IGF-1R, IL-11Ralpha, IL-13R-alpha2, IL-2, IL-22R-alpha, IL-6, IL-6R, Ia, Ii, L1-CAM, L1-cell adhesion molecule, Lewis Y, L1-CAM, MAGE A3, MAGE-A1, MART-1, MUC1, NKG2C ligands, NKG2D Ligands, NY-ESO-1, OEPHa2, PIGF, PSCA, PSMA, ROR1, T101, TAC, TAG72, TIM-3, TRAIL-R1, TRAIL-R1 (DR4), TRAIL-R2 (DR5), VEGF, VEGFR2, WT-1, a G-protein coupled receptor, alphafetoprotein (AFP), an angiogenesis factor, an exogenous cognate binding molecule (ExoCBM), oncogene product, anti-folate receptor, c-Met, carcinoembryonic antigen (CEA), cyclin (D1), ephrinB2, epithelial tumor antigen, estrogen receptor, fetal acethycholine e receptor, folate binding protein, gp100, hepatitis B surface antigen, kappa chain, kappa light chain, kdr, lambda chain, livin, melanoma-associated antigen, mesothelin, mouse double minute 2 homolog (MDM2), mucin 16 (MUC16), mutated p53, mutated ras, necrosis antigens, oncofetal antigen, ROR2, progesterone receptor, prostate specific antigen, tEGFR, tenascin, β2-Microglobulin, Fc Receptor-like 5 (FcRL5), or molecules expressed by HIV, HCV, HBV, or other pathogens.

In some embodiments, the antigen binding domain of the CAR polypeptide molecule comprises an antibody, an antibody fragment, an scFv, a Fv, a Fab, a (Fab')2, a single domain antibody (SDAB), a VH or VL domain, or a camelid VHH domain.

In some embodiments, the antigen binding domain of the CAR polypeptide molecule comprises a transmembrane domain of a protein chosen from an alpha, beta or zeta chain of a T-cell receptor, CD28, CD3 epsilon, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6

(NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C, or a functional variant thereof.

In some embodiments, the transmembrane domain comprises a transmembrane domain of CD28, e.g., IYIWAPLAGTCGVLLLSLVITLYC (SEQ ID NO: 12).

In some embodiments, the antigen binding domain of the CAR polypeptide molecule is connected to the transmembrane domain by a hinge region. In one embodiment, the encoded hinge region comprises the amino acid sequence of a CD8 hinge, e.g., SEQ ID NO: 403, or the amino acid sequence of an IgG4 hinge, e.g., SEQ ID NO: 405, or a sequence with at least 95-99% identity thereof. In other embodiments, the CAR molecule comprises: i) an antigen binding domain, ii) a transmembrane domain, and iii) an intracellular domain that comprises a costimulatory domain that comprises the amino acid sequence of RSKRSRLLHSDYMFMTPRRPGPTRKHYQPYAPPRDFAAYRS (SEQ ID NO: 2), wherein the intracellular domain further comprises a primary signaling domain.

In some embodiments, the CAR polypeptide molecule further comprises a leader sequence. In one embodiment, the leader sequence comprises the sequence of SEQ ID NO: 401.

In certain embodiments, the antigen binding domain of the CAR polypeptide molecule has a binding affinity KD of $10^{-4}$ M to $10^{-8}$ M. In one embodiment, the antigen binding domain is an antigen binding domain described herein, e.g., an antigen binding domain described herein for a target provided above. In one embodiment, the CAR molecule comprises an antigen binding domain that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the antigen binding domain has a binding affinity that is at least five-fold, 10-fold, 20-fold, 30-fold, 50-fold, 100-fold or 1,000-fold less than a reference antibody, e.g., an antibody described herein. In one embodiment, the encoded antigen binding domain has a binding affinity at least 5-fold less than a reference antibody (e.g., an antibody from which the antigen binding domain is derived).

In another aspect, the invention features an isolated CAR polypeptide molecule comprising an antigen binding domain, a transmembrane domain, and an intracellular signaling domain, wherein said antigen binding domain binds to a tumor-supporting antigen (e.g., a tumor-supporting antigen as described herein). In some embodiments, the tumor-supporting antigen is an antigen present on a stromal cell or a myeloid-derived suppressor cell (MDSC).

In some embodiments, the invention features a chimeric antigen receptor (CAR) molecule comprising: i) an antigen binding domain, ii) a transmembrane domain, and iii) an intracellular signaling domain that comprises a costimulatory domain that comprises the amino acid sequence of (SEQ ID NO: 1)
RSKRSRLLHSDX$_1$MX$_2$MTPRRPGPTRKHYQPYAPPRDFAAYRS, wherein X$_1$ is any amino acid, and X$_2$ is any amino acid, provided that SEQ ID NO: 1 is not RSKRSRLLHSDYMNMTPRRPGPTRKHYQPYAPPRDFAAYRS (SEQ ID NO: 5). In an embodiment, X$_1$ is F (Phe), and X$_2$ is any amino acid. In an embodiment, X$_1$ is Y (Tyr), and X$_2$ is any amino acid. In an embodiment, X$_1$ is any amino acid, and X$_2$ is F (Phe). In an embodiment, X$_1$ is any amino acid, and X$_2$ is N (Asn).

CAR-Expressing cells

In another aspect, the invention pertains to a cell, e.g., an immune effector cell, (e.g., a population of cells, e.g., a population of immune effector cells) comprising a nucleic acid molecule, a CAR polypeptide molecule, or a vector as described herein.

In one embodiment, the cell is a human T cell. In one embodiment, the cell is a cell described herein, e.g., a human T cell, e.g., a human T cell described herein; or a human NK cell, e.g., a human NK cell described herein. In one embodiment, the human T cell is a CD8+ T cell. In one embodiment, the cell is a T cell and the T cell is diacylglycerol kinase (DGK) deficient. In one embodiment, the cell is a T cell and the T cell is Ikaros deficient. In one embodiment, the cell is a T cell and the T cell is both DGK and Ikaros deficient.

In another embodiment, a CAR-expressing immune effector cell described herein can further express another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta, e.g., as described herein. In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta, or a fragment of any of these, and a second polypeptide which is an intracellular signaling domain described herein (e.g., comprising a costimulatory domain (e.g., 41BB, CD27 or CD28, e.g., as described herein, or a functional variant thereof) and/or a primary signaling domain (e.g., a CD3 zeta signaling domain described herein, or a functional variant thereof). In one embodiment, the agent comprises a first polypeptide of PD-1 or a fragment thereof, and a second polypeptide of an intracellular signaling domain described herein (e.g., a CD28, CD27, OX40 or 4-1BB signaling domain described herein, or a functional variant thereof, and/or a CD3 zeta signaling domain described herein, or a functional variant thereof).

In one embodiment, the CAR-expressing immune effector cell described herein can further comprise a second CAR, e.g., a second CAR that includes a different antigen binding domain, e.g., to the same target (e.g., a target described above) or a different target. In one embodiment, the second CAR includes an antigen binding domain to a target expressed on the same cancer cell type as the target of the first CAR. In one embodiment, the CAR-expressing immune effector cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain.

While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing immune effector cell comprises a first CAR that includes an antigen binding domain that targets, e.g., a target described above, a transmembrane domain and a costimulatory domain and a second CAR that targets an antigen other than antigen targeted by the first CAR (e.g., an antigen expressed on the same cancer cell type as the first target) and includes an antigen binding domain, a transmembrane domain and a primary signaling domain. In another embodiment, the CAR expressing immune effector cell comprises a first CAR that includes an antigen binding domain that targets, e.g., a target described above, a transmembrane domain and a primary signaling domain and a second CAR that targets an antigen other than antigen targeted by the first CAR (e.g., an antigen expressed on the same cancer cell type as the first target) and includes an antigen binding domain to the antigen, a transmembrane domain and a costimulatory signaling domain.

In one embodiment, the CAR-expressing immune effector cell comprises a CAR described herein, e.g., a CAR to a target described above and/or an inhibitory CAR. In one embodiment, the inhibitory CAR comprises an antigen binding domain that binds an antigen found on normal cells but not cancer cells, e.g., normal cells that also express the target. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta.

In one embodiment, an immune effector cell (e.g., T cell, NK cell) comprises a first CAR comprising an antigen binding domain that binds to a tumor antigen as described herein, and a second CAR comprising a PD1 extracellular domain or a fragment thereof.

In one embodiment, the cell further comprises an inhibitory molecule comprising: an inhKIR cytoplasmic domain; a transmembrane domain, e.g., a KIR transmembrane domain; and an inhibitor cytoplasmic domain, e.g., an ITIM domain, e.g., an inhKIR ITIM domain. In an embodiment the inhibitory molecule is a naturally occurring inhKIR, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring inhKIR.

In one embodiment, the cell further comprises an inhibitory molecule comprising: a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In an embodiment the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

In one embodiment, the second CAR in the cell is an inhibitory CAR, wherein the inhibitory CAR comprises an antigen binding domain, a transmembrane domain, and an intracellular domain of an inhibitory molecule. The inhibitory molecule can be chosen from one or more of: PD1, PD-L1, CTLA-4, TIM-3, LAG-3, VISTA, BTLA, TIGIT, LAIR1, CD160, 2B4, TGF beta, CEACAM-1, CEACAM-3, and CEACAM-5. In one embodiment, the second CAR molecule comprises the extracellular domain of PD1 or a fragment thereof.

In embodiments, the second CAR molecule in the cell further comprises an intracellular signaling domain comprising a primary signaling domain and/or an intracellular signaling domain.

In other embodiments, the intracellular signaling domain in the cell comprises a primary signaling domain comprising the functional domain of CD3 zeta, or a functional variant thereof, and a costimulatory signaling domain comprising the functional domain of 4-1BB, or a functional variant thereof. In other embodiments, the intracellular signaling domain in the cell comprises a primary signaling domain comprising the functional domain of CD3 zeta and a costimulatory signaling domain comprising the functional domain of 4-1BB.

In one embodiment, the second CAR molecule in the cell comprises the amino acid sequence of SEQ ID NO: 26.

In certain embodiments, the antigen binding domain of the first CAR molecule comprises a scFv and the antigen binding domain of the second CAR molecule does not comprise a scFv. For example, the antigen binding domain of the first CAR molecule comprises a scFv and the antigen binding domain of the second CAR molecule comprises a camelid VHH domain.

CD28 Polypeptides and Nucleic Acids

In another aspect, the present invention provides a polypeptide comprising a mutant CD28 sequence described herein. For instance, the present disclosure provides, in some aspects, a polypeptide comprising the amino acid sequence of SEQ ID NO: 1 or a sequence at least 90%, 95%, 97%, 98%, or 99% identical thereto, wherein $X_1$ is any amino acid and $X_2$ is any amino acid, provided that the polypeptide is not SEQ ID NO: 5.

The present disclosure provides, in some aspects, a polypeptide comprising the amino acid sequence of SEQ ID NO: 1 or a sequence with no more than 1, 2, 3, or 4 modifications of the amino acid sequence of SEQ ID NO: 1, wherein $X_1$ is any amino acid and $X_2$ is any amino acid, provided that the polypeptide is not SEQ ID NO: 5.

In some embodiments, $X_2$ is R (Arg), C (Cys), E (Glu), G (Gly), H (His), I (Ile), L (Leu), M (Met), F (Phe), S (Ser), T (Thr), W (Trp), Y (Tyr), V (Val). In some embodiments, $X_2$ is F (Phe). In some embodiments, $X_1$ is Y (Tyr). In some embodiments, the polypeptide comprises a sequence according to SEQ ID NO: 2. In some embodiments, the polypeptide comprises a sequence according to SEQ ID NO: 3. In some embodiments, the polypeptide comprises a sequence according to SEQ ID NO: 4.

In some embodiments, the polypeptide further comprises one or more of: a leader, an antigen binding domain, a hinge domain, a transmembrane domain, a primary signaling domain, or a switch domain.

The present disclosure also provides, in some aspects, a nucleic acid encoding a mutant CD28 polypeptide described herein, e.g., described above. In embodiments, the nucleic acid comprises a sequence according to SEQ ID NO: 6, 7, or 8.

Methods of Treatment

In another aspect, the present invention provides a method comprising administering a CAR molecule, e.g., as described herein, or a cell comprising one or more nucleic acids encoding a CAR molecule, e.g., as described herein. In one embodiment, the subject has a disorder described herein, e.g., the subject has cancer, e.g., the subject has a cancer which expresses a target antigen described herein. In one embodiment, the subject is a human.

In another aspect, the invention pertains to a method of treating a subject having a disease associated with expression of a cancer associated antigen as described herein comprising administering to the subject an effective amount of a cell comprising a CAR molecule, e.g., as described herein.

In yet another aspect, the invention features a method of treating a subject having a disease associated with expression of a tumor antigen, comprising administering to the subject an effective amount of a cell, e.g., an immune effector cell (e.g., a population of immune effector cells) comprising a CAR molecule, wherein the CAR molecule comprises an antigen binding domain, a transmembrane domain, and an intracellular domain, said intracellular domain comprises a costimulatory domain and/or a primary signaling domain, wherein said antigen binding domain binds to the tumor antigen associated with the disease, e.g. a tumor antigen as described herein.

In a related aspect, the invention features a method of treating a subject having a disease associated with expression of a tumor antigen. The method comprises administering to the subject an effective amount of a cell, e.g., an immune effector cell (e.g., a population of immune effector cells) comprising a CAR molecule, in combination with an agent that increases the efficacy of the immune cell, wherein:

the CAR molecule comprises an antigen binding domain, a transmembrane domain, and an intracellular domain comprising a costimulatory domain and/or a primary signaling domain, wherein said antigen binding domain binds to the tumor antigen associated with the disease, e.g. a tumor antigen as disclosed herein; and the agent that increases the efficacy of the immune cell is chosen from one or more of:
a protein phosphatase inhibitor;
a kinase inhibitor;
a cytokine;
an inhibitor of an immune inhibitory molecule; or
an agent that decreases the level or activity of a $T_{REG}$ cell.

In a related aspect, the invention features a method of treating a subject having a disease associated with expression of a tumor antigen, comprising administering to the subject an effective amount of a cell, e.g., an immune effector cell (e.g., a population of immune effector cells) comprising a CAR molecule, wherein:

the CAR molecule comprises an antigen binding domain, a transmembrane domain, and an intracellular domain comprising a costimulatory domain and/or a primary signaling domain, wherein said antigen binding domain binds to the tumor antigen associated with the disease, e.g., a tumor antigen as disclosed herein; and the antigen binding domain of the CAR molecule has a binding affinity at least 5-fold less than an antibody from which the antigen binding domain is derived.

In another aspect, the invention features a composition comprising an immune effector cell (e.g., a population of immune effector cells) comprising a CAR molecule, e.g., as described herein for use in the treatment of a subject having a disease associated with expression of a tumor antigen, e.g., a disorder as described herein.

In certain embodiments of any of the aforesaid methods or uses, the disease associated with a tumor antigen, e.g., a tumor antigen described herein, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In one embodiment, the disease is a cancer described herein, e.g., a cancer described herein as being associated with a target described herein. In one embodiment, the disease is a hematologic cancer. In one embodiment, the hematologic cancer is leukemia. In one embodiment, the cancer is selected from the group consisting of one or more acute leukemias including but not limited to B-cell acute lymphoid leukemia ("BALL"), T-cell acute lymphoid leukemia ("TALL"), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with expression of a tumor antigen described herein include, but not limited to, atypical and/or non-classical cancers, malignancies, precancerous conditions or proliferative diseases expressing a tumor antigen as described herein; and any combination thereof. In another embodiment, the disease associated with a tumor antigen described herein is a solid tumor.

In certain embodiments of any of the aforesaid methods or uses, the tumor antigen associated with the disease is chosen from one or more of: CD19, CD123, CD22, CD30, CD171, CS-1, CLL-1 (CLECL1), CD33, EGFRvIII, GD2, GD3, BCMA, Tn Ag, PSMA, ROR1, FLT3, TAG72, CD38, CD44v6, CEA, EPCAM, B7H3, KIT, IL-13Ra2, Mesothelin, IL-11Ra, PSCA, PRSS21, VEGFR2, LewisY, CD24, PDGFR-beta, SSEA-4, CD20, Folate receptor alpha, ERBB2 (Her2/neu), MUC1, EGFR, NCAM, Prostase, PAP, ELF2M, Ephrin B2, FAP, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, legumain, HPV E6, E7, intestinal carboxyl esterase, mut hsp70-2, CD79a, CD79b, CD72, LAIR1, FCAR, LILRA2, CD300LF, CLEC12A, BST2, EMR2, LY75, GPC3, FCRLS, and IGLL1.

In other embodiments of any of the aforesaid methods or uses, the tumor antigen associated with the disease is chosen from one or more of: TSHR, TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, Fucosyl GM1, sLe, GM3, TGS5, HMWMAA, o-acetyl-GD2, Folate receptor beta, TEM1/CD248, TEM7R, CLDN6, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRLS, and IGLL1.

In other embodiments of any of the aforesaid methods or uses, the tumor antigen associated with the disease is chosen from one or more of: TSHR, CLDN6, GPRC5D, CXORF61, CD97, CD179a, ALK, Polysialic acid, PLAC1, GloboH, NY-BR-1, UPK2, HAVCR1, ADRB3, PANX3, GPR20, LY6K, OR51E2, CD150, 5T4, ActRIIA, B7, BMCA, CA-125, CCNA1, CD123, CD126, CD138, CD14, CD148, CD15, CD19, CD20, CD200, CD21, CD22, CD23, CD24, CD25, CD26, CD261, CD262, CD30, CD33, CD362, CD37, CD38, CD4, CD40, CD40L, CD44, CD46, CD5, CD52, CD53, CD54, CD56, CD66a-d, CD74, CD8, CD80, CD92, CE7, CS-1, CSPG4, ED-B fibronectin, EGFR, EGFRvIII, EGP-2, EGP-4, EPHa2, ErbB2, ErbB3, ErbB4, FBP, GD2, GD3, HER1-HER2 in combination, HER2-HER3 in combination, HERV-K, HIV-1 envelope glycoprotein gp120, HIV-1 envelope glycoprotein gp41, HLA-DR, HM1.24, HMW-MAA, Her2, Her2/neu, IGF-1R, IL-11Ralpha, IL-13R-alpha2, IL-2, IL-22R-alpha, IL-6, IL-6R, Ia, Ii, L1-CAM, L1-cell adhesion molecule, Lewis Y, L1-CAM, MAGE A3, MAGE-A1, MART-1, MUC1, NKG2C ligands, NKG2D Ligands, NY-ESO-1, OEPHa2, PIGF, PSCA, PSMA, ROR1, T101, TAC, TAG72, TIM-3, TRAIL-R1, TRAIL-R1 (DR4), TRAIL-R2 (DR5), VEGF, VEGFR2, WT-1, a G-protein coupled receptor, alphafetoprotein (AFP), an angiogenesis factor, an exogenous cognate binding molecule (ExoCBM), oncogene product, anti-folate receptor, c-Met, carcinoembryonic antigen (CEA), cyclin (D1), ephrinB2, epithelial tumor antigen, estrogen receptor, fetal acethycholine e receptor, folate binding protein, gp100, hepatitis B surface antigen, kappa chain, kappa light chain, kdr, lambda chain, livin, melanoma-associated antigen, mesothelin, mouse double minute 2 homolog (MDM2), mucin 16 (MUC16), mutated p53, mutated ras, necrosis antigens, oncofetal antigen, ROR2, progesterone receptor, prostate specific antigen, tEGFR, tenascin, β2-Microglobulin, Fc Receptor-like 5 (FcRL5), or molecules expressed by HIV, HCV, HBV, or other pathogens.

In certain embodiments, the methods or uses are carried out in combination with an agent that increases the efficacy of the immune effector cell, e.g., an agent as described herein.

In any of the aforesaid methods or uses, the disease associated with expression of the tumor antigen is selected from the group consisting of a proliferative disease, a precancerous condition, a cancer, and a non-cancer related indication associated with expression of the tumor antigen.

The cancer can be a hematologic cancer, e.g., a cancer chosen from one or more of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, or pre-leukemia.

The cancer can also be chosen from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

Methods of Making CAR-Expressing Cells

In another aspect, the invention pertains to a method of making a cell (e.g., an immune effector cell or population thereof) comprising introducing into (e.g., transducing) a cell, e.g., a T cell or a NK cell described herein, with a vector of comprising a nucleic acid encoding a CAR, e.g., a CAR polypeptide, e.g., as described herein; or a nucleic acid encoding a CAR molecule, e.g., as described herein.

The cell in the methods is an immune effector cell (e.g., a T cell or a NK cell, or a combination thereof). In some embodiments, the cell in the methods is diacylglycerol kinase (DGK) and/or Ikaros deficient.

In some embodiment, the introducing the nucleic acid molecule encoding a CAR, e.g., as described herein, comprises transducing a vector comprising the nucleic acid molecule encoding a CAR, e.g., as described herein, or transfecting the nucleic acid molecule encoding a CAR, e.g., as described herein, wherein the nucleic acid molecule is an in vitro transcribed RNA.

In some embodiments, the method further comprises:
providing a population of immune effector cells (e.g., T cells or NK cells); and
removing T regulatory cells from the population, thereby providing a population of T regulatory-depleted cells;
wherein steps a) and b) are performed prior to introducing the nucleic acid encoding the CAR to the population. In embodiments of the methods, the T regulatory cells comprise CD25+ T cells, and are removed from the cell population using an anti-CD25 antibody, or fragment thereof. The anti-CD25 antibody, or fragment thereof, can be conjugated to a substrate, e.g., a bead.

In other embodiments, the population of T regulatory-depleted cells provided from step (b) contains less than 30%, 25%, 20%, 15%, 10%, 5%, 4%, 3%, 2%, 1% of CD25+ cells.

In yet other embodiments, the method further comprises:
removing cells from the population which express a tumor antigen that does not comprise CD25 to provide a population of T regulatory-depleted and tumor antigen depleted cells prior to introducing the nucleic acid encoding a CAR to the population. The tumor antigen can be selected from CD19, CD30, CD38, CD123, CD20, CD14 or CD11b, or a combination thereof.

In other embodiments, the method further comprises removing cells from the population which express a checkpoint inhibitor, to provide a population of T regulatory-depleted and inhibitory molecule depleted cells prior to introducing the nucleic acid encoding a CAR to the population. The checkpoint inhibitor can be chosen from PD-1, LAG-3, TIM3, B7-H1, CD160, P1H, 2B4, CEACAM (e.g., CEACAM-1, CEACAM-3, and/or CEACAM-5), TIGIT, CTLA-4, BTLA, and LAIR1.

Further embodiments disclosed herein encompass providing a population of immune effector cells. The population of immune effector cells provided can be selected based upon the expression of one or more of CD3, CD28, CD4, CD8, CD45RA, and/or CD45RO. In certain embodiments, the population of immune effector cells provided are CD3+ and/or CD28+.

In certain embodiments of the method, the method further comprises expanding the population of cells after the nucleic acid molecule encoding a CAR has been introduced.

In embodiments, the population of cells is expanded for a period of 8 days or less.

In certain embodiments, the population of cells is expanded in culture for 5 days, and the resulting cells are more potent than the same cells expanded in culture for 9 days under the same culture conditions.

In other embodiments, the population of cells is expanded in culture for 5 days show at least a one, two, three or four fold increase in cell doublings upon antigen stimulation as compared to the same cells expanded in culture for 9 days under the same culture conditions.

In yet other embodiments, the population of cells is expanded in culture for 5 days, and the resulting cells exhibit higher proinflammatory IFN-γ and/or GM-CSF levels, as compared to the same cells expanded in culture for 9 days under the same culture conditions.

In other embodiments, the population of cells is expanded by culturing the cells in the presence of an agent that stimulates a CD3/TCR complex associated signal and/or a ligand that stimulates a costimulatory molecule on the surface of the cells. The agent can be a bead conjugated with anti-CD3 antibody, or a fragment thereof, and/or anti-CD28 antibody, or a fragment thereof.

In other embodiments, the population of cells is expanded in an appropriate media that includes one or more interleukin that result in at least a 200-fold, 250-fold, 300-fold, or 350-fold increase in cells over a 14 day expansion period, as measured by flow cytometry.

In other embodiments, the population of cells is expanded in the presence IL-15 and/or IL-7.

In certain embodiments, the method further includes cryopreserving the population of the cells after the appropriate expansion period.

In yet other embodiments, the method of making disclosed herein further comprises contacting the population of immune effector cells with a nucleic acid encoding a telomerase subunit, e.g., hTERT. The nucleic acid encoding the telomerase subunit can be DNA.

The present invention also provides a method of generating a population of RNA-engineered cells, e.g., cells described herein, e.g., immune effector cells (e.g., T cells, NK cells), transiently expressing exogenous RNA. The method comprises introducing an in vitro transcribed RNA or synthetic RNA into a cell, where the RNA comprises a nucleic acid encoding a CAR molecule, e.g., as described herein.

In another aspect, the invention pertains to a method of providing an anti-tumor immunity in a subject comprising administering to the subject an effective amount of a cell comprising a CAR molecule, e.g., as described herein. In one embodiment, the cell is an autologous T cell or NK cell. In one embodiment, the cell is an allogeneic T cell or NK cell. In one embodiment, the autologous or allogenic T cell or NK cell lacks expression or has low expression of a functional TCR or a functional HLA. In one embodiment, the subject is a human.

In one aspect, the invention includes a population of autologous cells that are transfected or transduced with a vector comprising a nucleic acid molecule encoding a CAR molecule, e.g., as described herein. In one embodiment, the vector is a retroviral vector. In one embodiment, the vector is a self-inactivating lentiviral vector as described elsewhere herein. In one embodiment, the vector is delivered (e.g., by transfecting or electroporating) to a cell, e.g., a T cell or a NK cell, wherein the vector comprises a nucleic acid molecule encoding a CAR, e.g., as described herein, which is transcribed as an mRNA molecule, and the CARs of the present invention is translated from the RNA molecule and expressed on the surface of the cell.

In another aspect, the present invention provides a population of CAR-expressing cells, e.g., as described herein, e.g., CAR-expressing immune effector cells (e.g., T cells or NK cells). In some embodiments, the population of CAR-expressing cells comprises a mixture of cells expressing different CARs. For example, in one embodiment, the population of CAR-expressing immune effector cells (e.g., T cells or NK cells) can include a first cell expressing a CAR having an antigen binding domain that binds to a first tumor antigen as described herein, and a second cell expressing a CAR having a different antigen binding domain that binds to a second tumor antigen as described herein. As another example, the population of CAR-expressing cells can include a first cell expressing a CAR that includes an antigen binding domain that binds to a tumor antigen as described herein, and a second cell expressing a CAR that includes an antigen binding domain to a target other than a tumor antigen as described herein. In one embodiment, the population of CAR-expressing cells includes, e.g., a first cell expressing a CAR that includes a primary intracellular signaling domain, and a second cell expressing a CAR that includes a secondary signaling domain, e.g., a costimulatory signaling domain.

In another aspect, the present invention provides a population of cells wherein at least one cell in the population expresses a CAR having an antigen binding domain that binds to a tumor antigen as described herein, and a second cell expressing another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta. In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, LAG-3, CTLA-4, CD160, BTLA, LAIR1, TIM-3, CEACAM (e.g., CEACAM-1, CEACAM-3 and/or CEACAM-5), 2B4 and TIGIT, or a fragment of any of these, and a second polypeptide which is an intracellular signaling domain described herein (e.g., comprising a costimulatory domain (e.g., 41BB, CD27 or CD28, e.g., as described herein, or a functional variant thereof) and/or a primary signaling domain (e.g., a CD3 zeta signaling domain described herein, or a functional variant thereof). In one embodiment, the agent comprises a first polypeptide of PD-1 or a fragment thereof, and a second polypeptide of an intracellular signaling domain described herein (e.g., a CD28, CD27, OX40 or 4-IBB signaling domain described herein, or a functional variant thereof, and/or a CD3 zeta signaling domain described herein, or a functional variant thereof).

In one embodiment, the nucleic acid molecule encoding a CAR of the present invention molecule, e.g., as described herein, is expressed as an mRNA molecule. In one embodiment, the genetically modified CAR of the present invention-expressing cells, e.g., immune effector cells (e.g., T cells, NK cells), can be generated by transfecting or electroporating an RNA molecule encoding the desired CARs (e.g., without a vector sequence) into the cell. In one embodiment, a CAR of the present invention molecule is translated from the RNA molecule once it is incorporated and expressed on the surface of the recombinant cell.

BRIEF DESCRIPTION OF THE DRAWINGS

FIG. 1A is a schematic representation of a panel of chimeric antigen receptors that contain the SS1 scFv and differ in the intracellular domain. The CD28 mutants contain the CD28 transmembrane and intracellular domains with point mutations in the YMFM (SEQ ID NO: 1937) motif. FIG. 1A discloses "YMFM" as SEQ ID NO: 1937, "FMNM" as SEQ ID NO: 1948, and "FMFM" as SEQ ID NO: 1949.

FIG. 1B is a list of amino acid sequences for the costimulatory domain of CAR T cells with the modified motif highlighted. FIG. 1B discloses "YMFM" as SEQ ID NO: 1937, "FMNM" as SEQ ID NO: 1948, and "FMFM" as SEQ ID NO: 1949. FIG. 1B also discloses SEQ ID NOs: 5, 2, 4, 3, and 1950, respectively, in order of appearance.

FIG. 2A discloses "YMFM" as SEQ ID NO: 1937, "FMNM" as SEQ ID NO: 1948, and "FMFM" as SEQ ID NO: 1949.

FIG. 2B discloses "YMFM" as SEQ ID NO: 1937, "FMNM" as SEQ ID NO: 1948, and "FMFM" as SEQ ID NO: 1949.

FIG. 3A is graph of tumor volume in NSG mice bearing subcutaneous pancreatic tumors (Capan-2) after tumor implantation with two doses of T cell redirected with SS1-CARs. Tumor volume was analyzed at indicated time points. Results are expressed as mean tumor volume (+/−SE) with n=8-9 mice per group. FIG. 3A discloses "YMFM" as SEQ ID NO: 1937, "FMNM" as SEQ ID NO: 1948, and "FMFM" as SEQ ID NO: 1949.

FIG. 3B is a pair of graphs showing the concentration of CD4+ and CD8+ T cells in the blood of treated animals 30 days after T cell injection. Error bars represent SEM (n=8-9). FIG. 3B discloses "YMFM" as SEQ ID NO: 1937, "FMNM" as SEQ ID NO: 1948, and "FMFM" as SEQ ID NO: 1949.

FIG. 3C is a pair of graphs showing the concentration of CD4+ and CD8+ T cells in the blood of treated animals 60 days after T cell injection. Error bars represent SEM (n=8-9). FIG. 3C discloses "YMFM" as SEQ ID NO: 1937, "FMNM" as SEQ ID NO: 1948, and "FMFM" as SEQ ID NO: 1949.

FIG. 4B discloses "YMFM" as SEQ ID NO: 1937.

FIG. 5A discloses "YMFM" as SEQ ID NO: 1937.

FIG. 5B discloses "YMFM" as SEQ ID NO: 1937.

FIG. 6A discloses "YMFM" as SEQ ID NO: 1937.

FIGS. 6B and 6C disclose "YMFM" as SEQ ID NO: 1937.

DETAILED DESCRIPTION

Figure 2A:
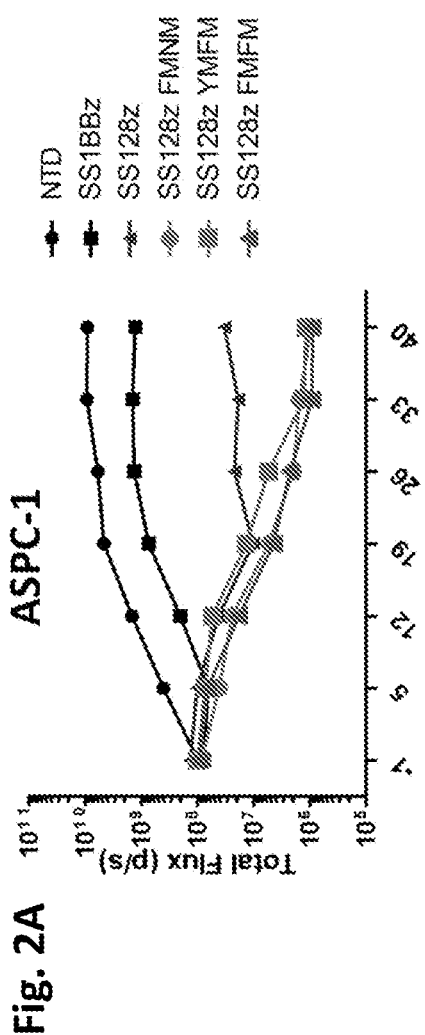
FIG. 2A is a graph of serial bioluminescence imaging of NSG mice bearing luciferase+ ASPC-1 tumor, injected intraperitoneally, and treated with the indicated T cells.

In general, the invention features T-cell containing a chimeric antigen T cell receptor comprising a mutant CD28 costimulatory domain. This invention is based, at least in part, on the discovery that the CAR molecules comprising a mutant CD28 costimulatory domain in T cells result in increased killing of tumor cells and increased T cell persistence in vitro and in vivo.

Definitions

Unless defined otherwise, all technical and scientific terms used herein have the same meaning as commonly understood by one of ordinary skill in the art to which the invention pertains.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. The terms "CAR" and "CAR molecule" are used interchangeably. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some embodiments, the set of polypeptides are in the same polypeptide chain (e.g., comprise a chimeric fusion protein). In some aspects, the set of polypeptides are contiguous with each other. In some embodiments, the set of polypeptides are not contiguous with each other, e.g., are in different polypeptide chains. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4-1BB (i.e., CD137), CD27 and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

A CAR that comprises an antigen binding domain (e.g., a scFv, or TCR) that targets a specific tumor maker X, such as those described herein, is also referred to as XCAR. For example, a CAR that comprises an antigen binding domain that targets CD19 is referred to as CD19CAR.

The term "signaling domain" refers to the functional portion of a protein which acts by transmitting information within the cell to regulate cellular activity via defined signaling pathways by generating second messengers or functioning as effectors by responding to such messengers.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), or a combination thereof.

As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival.

The term "autologous" refers to any material derived from the same individual to whom it is later to be re-introduced into the individual.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to a graft derived from an animal of a different species.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The compositions and methods of the present invention encompass polypeptides and nucleic acids having the sequences specified, or sequences substantially identical or similar thereto, e.g., sequences at least 85%, 90%, or 95% identical or higher to the sequence specified. In the context of an amino acid sequence, the term "substantially identical" is used herein to refer to a first amino acid sequence that contains a sufficient or minimum number of amino acid residues that are i) identical to, or ii) conservative substitutions of aligned amino acid residues in a second amino acid sequence such that the first and second amino acid sequences can have a common structural domain and/or common functional activity, for example, amino acid sequences that contain a common structural domain having at least about 85%, 90%. 91%, 92%, 93%, 94%, 95%, 96%, 97%, 98% or 99% identity to a reference sequence, e.g., a sequence provided herein.

In the context of a nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity, for example, nucleotide sequences having at least about 85%, 90%, 91%, 92%, 93%, 94%, 95%, 96%, 97%, 98% or 99% identity to a reference sequence, e.g., a sequence provided herein.

The term "variant" refers to a polypeptide that has a substantially identical amino acid sequence to a reference amino acid sequence, or is encoded by a substantially identical nucleotide sequence. In some embodiments, the variant is a functional variant.

The term "functional variant" refers to a polypeptide that has a substantially identical amino acid sequence to a reference amino acid sequence, or is encoded by a substantially identical nucleotide sequence, and is capable of having one or more activities of the reference amino acid sequence.

The phrase "disease associated with expression of a tumor antigen as described herein" includes, but is not limited to, a disease associated with expression of a tumor antigen as described herein or condition associated with cells which express a tumor antigen as described herein including, e.g., proliferative diseases such as a cancer or malignancy or a precancerous condition such as a myelodysplasia, a myelodysplastic syndrome or a preleukemia; or a noncancer related indication associated with cells which express a tumor antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but not limited to, e.g., atypical and/or non-classical cancers, malignancies, precancerous conditions or proliferative diseases associated with expression of a tumor antigen as described herein. Non-cancer related indications associated with expression of a tumor antigen as described herein include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (or tumor antigen in the case of a CAR) thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12, or a functional variant thereof. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:18, or the equivalent residues from a non-human species, e.g., mouse, rodent, monkey, ape and the like. In a specific CAR of the invention, the primary signaling sequence of CD3-zeta is the sequence as provided in SEQ ID NO:20, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12, or a functional variant thereof.

The term "zeta" or alternatively "zeta chain", "CD3-zeta" or "TCR-zeta" is defined as the protein provided as GenBank Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:18. In one aspect, the "zeta stimulatory domain" or a "CD3-zeta stimulatory domain" is the sequence provided as SEQ ID NO:20.

The term a "costimulatory molecule" refers to a cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are contribute to an efficient immune response. Costimulatory molecules include, but are not limited to an MHC class I molecule, BTLA and a Toll ligand receptor, as well as OX40, CD27, CD28, CD5, ICAM-1, LFA-1 (CD11a/CD18), ICOS (CD278), and 4-1BB (CD137). Further examples of such costimulatory molecules include CD5, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CD5, CD7, CD287, LIGHT, NKG2C, NKG2D, SLAMF7, NKp80, NKp30, NKp44, NKp46, CD160, B7-H3, and a ligand that specifically binds with CD83, and the like.

The intracellular signaling domain can comprise the entire intracellular portion, or the entire native intracellular signaling domain, of the molecule from which it is derived, or a functional fragment or derivative thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:14 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloid-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "lentivirus" refers to a genus of the Retroviridae family Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically a protein, carbohydrate or lipid) that is expressed on the surface of a cancer cell, either entirely or as a fragment (e.g., MHC/peptide), and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "tumor-supporting antigen" or "cancer-supporting antigen" interchangeably refer to a molecule (typically a protein, carbohydrate or lipid) that is expressed on the surface of a cell that is, itself, not cancerous, but supports the cancer cells, e.g., by promoting their growth or survival e.g., resistance to immune cells. Exemplary cells of this type include stromal cells and myeloid-derived suppressor cells (MDSCs). The tumor-supporting antigen itself need not play a role in supporting the tumor cells so long as the antigen is present on a cell that supports cancer cells.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)$_n$, where n is a positive integer equal to or greater than 1. For example, n=1, n=2, n=3. n=4, n=5 and n=6, n=7, n=8, n=9 and n=10 (SEQ ID NO:28). In one embodiment, the flexible polypeptide linkers include, but are not limited to, (Gly4 Ser)$_4$ (SEQ ID NO:29) or (Gly4 Ser)$_3$ (SEQ ID NO:30). In another embodiment, the linkers include multiple repeats of (Gly2Ser), (GlySer) or (Gly3Ser) (SEQ ID NO:31). Also included within the scope of the invention are linkers described in WO2012/138475, incorporated herein by reference).

As used herein, a 5' cap (also termed an RNA cap, an RNA 7-methylguanosine cap or an RNA m$^7$G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 34), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a binding partner (e.g., a tumor antigen) protein present in a sample, but which antibody or ligand does not substantially recognize or bind other molecules in the sample.

"Regulatable chimeric antigen receptor (RCAR)," as that term is used herein, refers to a set of polypeptides, typically two in the simplest embodiments, which when in a RCARX cell, provides the RCARX cell with specificity for a target cell, typically a cancer cell, and with regulatable intracellular signal generation or proliferation, which can optimize an immune effector property of the RCARX cell. An RCARX cell relies at least in part, on an antigen binding domain to provide specificity to a target cell that comprises the antigen bound by the antigen binding domain. In an embodiment, an RCAR includes a dimerization switch that, upon the presence of a dimerization molecule, can couple an intracellular signaling domain to the antigen binding domain.

"Membrane anchor" or "membrane tethering domain", as that term is used herein, refers to a polypeptide or moiety, e.g., a myristoyl group, sufficient to anchor an extracellular or intracellular domain to the plasma membrane.

"Switch domain," as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g., RAD001.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive T cells and/or an increase in the number of PD-1 negative T cells, or an increase in the ratio of PD-1 negative T cells/PD-1 positive T cells. In an embodiment, the low, immune enhancing, dose of mTOR inhibitor results in an increase in the number of naive T cells. In an embodiment, the low, immune enhancing, dose of mTOR inhibitor results in one or more of the following:

an increase in the expression of one or more of the following markers: $CD62L^{high}$, $CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased $CD62L^{high}$ increased $CD127^{high}$, increased $CD27^+$, decreased KLRG1, and increased BCL2;

wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" as used herein refers to the return of a disease (e.g., cancer) or the signs and symptoms of a disease such as cancer after a period of improvement, e.g., after prior treatment of a therapy, e.g., cancer therapy Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Description

Provided herein are compositions of matter and methods of use for the treatment of a disease such as cancer using immune effector cells (e.g., T cells, NK cells) engineered with CARs of the invention, e.g., CARs comprising a mutant CD28 domain.

In some embodiments, a CAR herein has reduced Grb2 binding compared to an otherwise similar CAR molecule comprising the wild-type CD28 amino acid sequence of SEQ ID NO: 5. Grb2 binding is measured, e.g., by the assay in Harada et al., "A single amino acid alteration in cytoplasmic domain determines IL-2 promoter activation by ligation of CD28 but not inducible costimulator (ICOS)." J Exp Med. 2003 Jan. 20; 197(2):257-62.

In one aspect, the invention provides a number of chimeric antigen receptors (CAR) comprising an antigen binding domain (e.g., antibody or antibody fragment, TCR or TCR fragment) engineered for specific binding to a tumor antigen, e.g., a tumor antigen described herein. In one aspect, the invention provides an immune effector cell (e.g., T cell, NK cell) engineered to express a CAR, wherein the engineered immune effector cell exhibits an anticancer property. In one aspect, a cell is transformed with the CAR and the CAR is expressed on the cell surface. In some embodiments, the cell (e.g., T cell, NK cell) is transduced with a viral vector encoding a CAR. In some embodiments, the viral vector is a retroviral vector. In some embodiments, the viral vector is a lentiviral vector. In some such embodiments, the cell may stably express the CAR. In another embodiment, the cell (e.g., T cell, NK cell) is transfected with a nucleic acid, e.g., mRNA, cDNA, DNA, encoding a CAR. In some such embodiments, the cell may transiently express the CAR.

In one aspect, the antigen binding domain of a CAR described herein is a scFv antibody fragment. In one aspect, such antibody fragments are functional in that they retain the equivalent binding affinity, e.g., they bind the same antigen with comparable affinity, as the IgG antibody from which it is derived. In other embodiments, the antibody fragment has a lower binding affinity, e.g., it binds the same antigen with a lower binding affinity than the antibody from which it is derived, but is functional in that it provides a biological response described herein. In one embodiment, the CAR molecule comprises an antibody fragment that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the antibody fragment has a binding affinity that is at least five-fold, 10-fold, 20-fold, 30-fold, 50-fold, 100-fold or 1,000-fold less than a reference antibody, e.g., an antibody described herein.

In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan.

In one aspect, the antigen binding domain of the CAR is a scFv antibody fragment that is humanized compared to the murine sequence of the scFv from which it is derived.

In one aspect, the antigen binding domain of a CAR of the invention (e.g., a scFv) is encoded by a nucleic acid molecule whose sequence has been codon optimized for expression in a mammalian cell. In one aspect, entire CAR construct of the invention is encoded by a nucleic acid molecule whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

In one aspect, the CARs of the invention combine an antigen binding domain of a specific antibody with an intracellular signaling molecule. For example, in some aspects, the intracellular signaling molecule includes, but is not limited to, CD3-zeta chain, 4-1BB and CD28 signaling modules and combinations thereof. In one aspect, the antigen binding domain binds to a tumor antigen as described herein.

Furthermore, the present invention provides CARs and CAR-expressing cells and their use in medicaments or methods for treating, among other diseases, cancer or any malignancy or autoimmune diseases involving cells or tissues which express a tumor antigen as described herein.

In one aspect, the CAR of the invention can be used to eradicate a normal cell that express a tumor antigen as described herein, thereby applicable for use as a cellular conditioning therapy prior to cell transplantation. In one aspect, the normal cell that expresses a tumor antigen as described herein is a normal stem cell and the cell transplantation is a stem cell transplantation.

In one aspect, the invention provides an immune effector cell (e.g., T cell, NK cell) engineered to express a chimeric antigen receptor (CAR), wherein the engineered immune effector cell exhibits an antitumor property. A preferred antigen is a cancer associated antigen (i.e., tumor antigen) described herein. In one aspect, the antigen binding domain of the CAR comprises a partially humanized antibody fragment. In one aspect, the antigen binding domain of the CAR comprises a partially humanized scFv. Accordingly, the invention provides CARs that comprises a humanized antigen binding domain and is engineered into a cell, e.g., a T cell or a NK cell, and methods of their use for adoptive therapy.

In one aspect, the CARs of the invention comprise at least one intracellular domain selected from the group of a CD137 (4-1BB) signaling domain, a CD28 signaling domain, a CD27 signal domain, a CD3zeta signal domain, a functional variant thereof, and any combination thereof. In one aspect, the CARs of the invention comprise at least one intracellular signaling domain is from one or more costimulatory molecule(s) other than a CD137 (4-1BB) or CD28.

Sequences of some examples of various components of CARs of the instant invention is listed in Table 1, where aa stands for amino acids, and na stands for nucleic acids that encode the corresponding peptide.

TABLE 1

Sequences of various components of CAR (aa—amino acids, na—nucleic acids that encodes the corresponding protein)

| SEQ ID NO | description | Sequence |
| --- | --- | --- |
| 400 | EF-1 promoter | CGTGAGGCTCCGGTGCCCGTCAGTGGGCAGAGCGCACATCGCCC<br>ACAGTCCCCGAGAAGTTGGGGGGAGGGGTCGGCAATTGAACCGG<br>TGCCTAGAGAAGGTGGCGCGGGGTAAACTGGGAAAGTGATGTCG<br>TGTACTGGCTCCGCCTTTTTCCCGAGGGTGGGGGAGAACCGTATA<br>TAAGTGCAGTAGTCGCCGTGAACGTTCTTTTTCGCAACGGGTTTG<br>CCGCCAGAACACAGGTAAGTGCCGTGTGTGGTTCCCGCGGGCCTG<br>GCCTCTTTACGGGTTATGGCCCTTGCGTGCCTTGAATTACTTCCAC<br>CTGGCTGCAGTACGTGATTCTTGATCCCGAGCTTCGGGTTGGAAG<br>TGGGTGGGAGAGTTCGAGGCCTTGCGCTTAAGGAGCCCCTTCGCC<br>TCGTGCTTGAGTTGAGGCCTGGCCTGGGCGCTGGGGCCGCCGCGT<br>GCGAATCTGGTGGCACCTTCGCGCCTGTCTCGCTGCTTTCGATAA<br>GTCTCTAGCCATTTAAAATTTTTGATGACCTGCTGCGACGCTTTTT<br>TTCTGGCAAGATAGTCTTGTAAATGCGGGCCAAGATCTGCACACT<br>GGTATTTCGGTTTTTGGGGCCGCGGGCGGCGACGGGGCCCGTGCG<br>TCCCAGCGCACATGTTCGGCGAGGCGGGGCCTGCGAGCGCGGCC<br>ACCGAGAATCGGACGGGGGTAGTCTCAAGCTGGCCGGCCTGCTCT<br>GGTGCCTGGCCTCGCGCCGCCGTGTATCGCCCCGCCCTGGGCGGC<br>AAGGCTGGCCCGGTCGGCACCAGTTGCGTGAGCGGAAAGATGGC<br>CGCTTCCCGGCCCTGCTGCAGGGAGCTCAAAATGGAGGACGCGG<br>CGCTCGGGAGAGCGGGCGGGTGAGTCACCCACACAAAGGAAAAG<br>GGCCTTTCCGTCCTCAGCCGTCGCTTCATGTGACTCCACGGAGTA<br>CCGGGCGCCGTCCAGGCACCTCGATTAGTTCTCGAGCTTTTGGAG<br>TACGTCGTCTTTAGGTTGGGGGGAGGGGTTTTATGCGATGGAGTT<br>TCCCCACACTGAGTGGGTGGAGACTGAAGTTAGGCCAGCTTGGCA<br>CTTGATGTAATTCTCCTTGGAATTTGCCCTTTTTGAGTTTGGATCT<br>TGGTTCATTCTCAAGCCTCAGACAGTGGTTCAAAGTTTTTTCTTC<br>CATTTCAGGTGTCGTGA |
| 401 | Leader (aa) | MALPVTALLLPLALLLHAARP |
| 402 | Leader (na) | ATGGCCCTGCCTGTGACAGCCCTGCTGCTGCCTCTGGCTCTGCTG<br>TGCATGCCGCTAGACCC |
| 403 | CD 8 hinge (aa) | TTTPAPRPPTPAPTIASQPLSLRPEACRPAAGGAVHTRGLDFACD |
| 404 | CD8 hinge (na) | ACCACGACGCCAGCGCCGCGACCACCAACACCGGCGCCCACCAT<br>CGCGTCGCAGCCCCTGTCCCTGCGCCCAGAGGCGTGCCGGCCAGC<br>GGCGGGGGGCGCAGTGCACACGAGGGGGCTGGACTTCGCCTGTG<br>AT |
| 405 | Ig4 hinge (aa) | ESKYGPPCPPCPAPEFLGGPSVFLFPPKPKDTLMISRTPEVTCVVVDV<br>SQEDPEVQFNWYVDGVEVHNAKTKPREEQFNSTYRVVSVLTVLHQ<br>DWLNGKEYKCKVSNKGLPSSIEKTISKAKGQPREPQVYTLPPSQEEM<br>TKNQVSLTCLVKGFYPSDIAVEWESNGQPENNYKTTPPVLDSDGSFF<br>LYSRLTVDKSRWQEGNVFSCSVMHEALHNHYTQKSLSLSLGKM |
| 406 | Ig4 hinge (na) | GAGAGCAAGTACGGCCCTCCCTGCCCCCCTTGCCCTGCCCCCGAG<br>TTCCTGGGCGGACCCAGCGTGTTCCTGTTCCCCCCCAAGCCCAAG<br>GACACCCTGATGATCAGCCGGACCCCCGAGGTGACCTGTGTGGTG<br>GTGGACGTGTCCCAGGAGGACCCCGAGGTCCAGTTCAACTGGTAC<br>GTGGACGGCGTGGAGGTGCACAACGCCAAGACCAAGCCCCGGGA<br>GGAGCAGTTCAATAGCACCTACCGGGTGGTGTCCGTGCTGACCGT<br>GCTGCACCAGGACTGGCTGAACGGCAAGGAATACAAGTGTAAGG<br>TGTCCAACAAGGGCCTGCCCAGCAGCATCGAGAAAACCATCAGC<br>AAGGCCAAGGGCCAGCCTCGGGAGCCCCAGGTGTACACCCTGCC<br>CCCTAGCCAAGAGGAGATGACCAAGAACCAGGTGTCCCTGACCT<br>GCCTGGTGAAGGGCTTCTACCCCAGCGACATCGCCGTGGAGTGG<br>GAGAGCAACGGCCAGCCCGAGAACAACTACAAGACCACCCCCCT<br>GTGCTGGACAGCGACGGCAGCTTCTTCCTGTACAGCCGGCTGACC<br>GTGGACAAGAGCCGGTGGCAGGAGGGCAACGTCTTTAGCTGCTC<br>CGTGATGCACGAGGCCCTGCACAACCACTACACCCAGAAGAGCC<br>TGAGCCTGTCCCTGGGCAAGATG |
| 407 | IgD hinge (aa) | RWPESPKAQASSVPTAQPQAEGSLAKATTAPATTRNTGRGGEEKKK<br>EKEKEEQEERETKTPECPSHTQPLGVYLLTPAVQDLWLRDKATFTCF<br>VVGSDLKDAHLTWEVAGKVPTGGVEEGLLERHSNGSQSQHSRLTLP<br>RSLWNAGTSVTCTLNHPSLPPQRLMALREPAAQAPVKLSLNLLASSD<br>PPEAASWLLCEVSGFSPPNILLMWLEDQREVNTSGFAPARPPPQPGST<br>TFWAWSVLRVPAPPSPQPATYTCVVSHEDSRTLLNASRSLEVSYVTDH |

TABLE 1-continued

Sequences of various components of CAR (aa-amino acids, na-nucleic acids that encodes the corresponding protein)

| SEQ ID NO | description | Sequence |
|---|---|---|
| 4 | IgD hinge (na) | AGGTGGCCCGAAAGTCCCAAGGCCCAGGCATCTAGTGTTCCTACT GCACAGCCCCAGGCAGAAGGCAGCCTAGCCAAAGCTACTACTGC ACCTGCCACTACGCGAATACTGGCCGTGGCGGGGAGGAGAAGA AAAAGGAGAAAGAGAAAGAAGAACAGGAAGAGAGGGAGACCAA GACCCCTGAATGTCCATCCCATACCCAGCCGCTGGGCGTCTATCT CTTGACTCCCGCAGTACAGGACTTGTGGCTTAGAGATAAGGCCAC CTTTACATGTTTCGTCGTGGGCTCTGACCTGAAGGATGCCCATTTG ACTTGGGAGGTTGCCGGAAAGGTACCCACAGGGGGGGTTGAGGA AGGGTTGCTGGAGCGCCATTCCAATGGCTCTCAGAGCCAGCACTC AAGACTCACCCTTCCGAGATCCCTGTGGAACGCCGGGACCTCTGT CACATGTACTCTAAATCATCCTAGCCTGCCCCCACAGCGTCTGAT GGCCCTTAGAGAGCCAGCCGCCCAGGCACCAGTTAAGCTTAGCCT GAATCTGCTCGCCAGTAGTGATCCCCCAGAGGCCGCCAGCTGGCT CTTATGCGAAGTGTCCGGCTTTAGCCCGCCCAACATCTTGCTCAT GTGGCTGGAGGACCAGCGAGAAGTGAACACCAGCGGCTTCGCTC CAGCCCGGCCCCACCCCAGCCGGGTTCTACCACATTCTGGGCCT GGAGTGTCTTAAGGGTCCCAGCACCACCTAGCCCCCAGCCAGCCA CATACACCTGTGTTGTGTCCCATGAAGATAGCAGGACCCTGCTAA ATGCTTCTAGGAGTCTGGAGGTTTCCTACGTGACTGACCATT |
| 10 | GS hinge/linker (aa) | GGGGSGGGGS |
| 11 | GS hinge/linker (na) | GGTGGCGGAGGTTCTGGAGGTGGAGGTTCC |
| 12 | CD8TM (aa) | IYIWAPLAGTCGVLLLSLVITLYC |
| 13 | CD8 TM (na) | ATCTACATCTGGGCGCCCTTGGCCGGGACTTGTGGGGTCCTTCTC CTGTCACTGGTTATCACCCTTTACTGC |
| 14 | 4-1BB intracellular domain (aa) | KRGRKKLLYIFKQPFMRPVQTTQEEDGCSCRFPEEEEGGCEL |
| 15 | 4-1BB intracellular domain (na) | AAACGGGGCAGAAAGAAACTCCTGTATATATTCAAACAACCATTT ATGAGACCAGTACAAACTACTCAAGAGGAAGATGGCTGTAGCTG CCGATTTCCAGAAGAAGAAGAAGGAGGATGTGAACTG |
| 16 | CD27 (aa) | QRRKYRSNKGESPVEPAEPCRYSCPREEEGSTIPIQEDYRKPEPACSP |
| 17 | CD27 (na) | AGGAGTAAGAGGAGCAGGCTCCTGCACAGTGACTACATGAACAT GACTCCCCGCCGCCCCGGGCCCACCCGCAAGCATTACCAGCCCTA TGCCCCACCACGCGACTTCGCAGCCTATCGCTCC |
| 18 | CD3-zeta (aa) | RVKFSRSADAPAYKQGQNQLYNELNLGRREEYDVLDKRRGRDPEM GGKPRRKNPQEGLYNELQKDKMAEAYSEIGMKGERRRGKGHDGLY QGLSTATKDTYDALHMQALPPR |
| 19 | CD3-zeta (na) | AGAGTGAAGTTCAGCAGGAGCGCAGACGCCCCCGCGTACAAGCA GGGCCAGAACCAGCTCTATAACGAGCTCAATCTAGGACGAAGAG AGGAGTACGATGTTTTGGACAAGAGACGTGGCCGGGACCCTGAG ATGGGGGGAAAGCCGAGAAGGAAGAACCCTCAGGAAGGCCTGTA CAATGAACTGCAGAAAGATAAGATGGCCGAGGCCTACAGTGAGA TTGGGATGAAAGGCGAGCGCCGGAGGGGCAAGGGGCACGATGGC CTTTACCAGGGTCTCAGTACAGCCACCAAGGACACCTACGACGCC CTTCACATGCAGGCCCTGCCCCCTCGC |
| 20 | CD3-zeta (aa) | RVKFSRSADAPAYQQGQNQLYNELNLGRREEYDVLDKRRGRDPEM GGKPRRKNPQEGLYNELQKDKMAEAYSEIGMKGERRRGKGHDGLY QGLSTATKDTYDALHMQALPPR |
| 21 | CD3-zeta (na) | AGAGTGAAGTTCAGCAGGAGCGCAGACGCCCCCGCGTACCAGCA GGGCCAG AACCAGCTCTATAACGAGCTCAATCTAGGACGAAGAGAGGAGTA CGATGTTT TGGACAAGAGACGTGGCCGGGACCCTGAGATGGGGGGAAAGCCG AGAAGGA AGAACCCTCAGGAAGGCCTGTACAATGAACTGCAGAAAGATAAG ATGGCGG |

TABLE 1-continued

Sequences of various components of CAR (aa—amino acids, na—nucleic acids that encodes the corresponding protein)

| SEQ ID NO | description | Sequence |
|---|---|---|
| | | AGGCCTACAGTGAGATTGGGATGAAAGGCGAGCGCCGGAGGGGC<br>AAGGGGC<br>ACGATGGCCTTTACCAGGGTCTCAGTACAGCCACCAAGGACACCT<br>ACGACGC<br>CCTTCACATGCAGGCCCTGCCCCCTCGC |
| 22 | linker | GGGGS |
| 23 | linker | GGTGGCGGAGGTTCTGGAGGTGGAGGTTCC |
| 24 | PD-1 extracellular domain (aa) | Pgwfldspdrpwnpptfspallvvtegdnatftcsfsntsesfvlnwyrmspsnqtdklaafpedrsqpg<br>qdcrfrvtqlpngrdfhmsvvrarrndsgtylcgaislapkaqikeslraelrvterraevptahpspsprpa<br>gqfqtlv |
| 25 | PD-1 extracellular domain (na) | Cccggatggtttctggactctccggatcgcccgtggaatcccccaaccttctcaccggcactcttggttgtgac<br>tgagggcgataatgcgaccttcacgtgctcgttctccaacacctccgaatcattcgtgctgaactggtaccgca<br>tgagcccgtcaaaccagaccgacaagctcgccgcgtttccggaagatcggtcgcaaccgggacaggattgt<br>cggttccgcgtgactcaactgccgaatggcagagacttccacatgagcgtggtccgcgctaggcgaaacga<br>ctccgggacctacctgtgcggagccatctcgctggcgcctaaggcccaaatcaaagagagcttgagggccg<br>aactgagagtgaccgagcgcagagctgaggtgccaactgcacatccatcccatcgcctcggcctgcggg<br>gcagtttcagaccctggtc |
| 26 | PD-1 CAR (aa) with signal | Malpvtalllplalllhaarppgwfldspdrpwnpptfspallvvtegdnatftcsfsntsesfvlnwyrms<br>psnqtdklaafpedrsqpgqdcrfrvtqlpngrdfhmsvvrarrndsgtylcgaislapkaqikeslraelr<br>vterraevptahpspsprpagqfqtlvtttpaprpptpaptiasqplslrpeacrpaaggavhtrgldfacdiy<br>iwaplagtcgvlllslvitlyckrgrkkllyifkqpfmrpvqttqeedgcscrfpeeeeggcelrvkfsrsad<br>apaykqgqnqlynelnlgrreeydvldkrrgrdpemggkpprrknpqeglynelqkdkmaeaysefigm<br>kgerrrgkghdglyqglstatkdtydalhmqalppr |
| 27 | PD-1 CAR (na) | Atggccctccctgtcactgccctgcttctcccctcgcactcctgctccacgccgctagaccaccggatggt<br>ttctggactctccggatcgcccgtggaatcccccaaccttctcaccggcactcttggttgtgactgagggcgat<br>aatgcgaccttcacgtgctcgttctccaacacctccgaatcattcgtgctgaactggtaccgcatgagcccgtc<br>aaaccagaccgacaagctcgccgcgtttccggaagatcggtcgcaaccgggacaggattgtcggttccgcg<br>tgactcaactgccgaatggcagagacttccacatgagcgtggtccgcgctaggcgaaacgactccgggacc<br>tacctgtgcggagccatctcgctggcgcctaaggcccaaatcaaagagagcttgagggccgaactgagagt<br>gaccgagcgcagagctgaggtgccaactgcacatccatcccatcgcctcggcctgcggggcagtttcaga<br>ccctggtcacgaccactccggcgccgcgccaccgactccggccccaactatcgcgagccagcccctgtc<br>gctgaggccggaagcatgccgccctgccgccggaggtgctgtgcatacccggggattggacttcgcatgc<br>gacatctacatttgggctcctctcgccggaacttgtgcgtgctccttctgtccctggtcatcaccctgtactgca<br>agcggggtcggaaaaagcttctgtacatttttcaagcagcccttcatgaggcccgtgcaaaccacccaggagg<br>aggacggttgctcctgccggttccccgaagaggaagaaggaggttgcgagctgcgcgtgaagttctcccgg<br>agcgccgacgcccccgcctataagcagggccagaaccagctgtacaacgaactgaacctgggacggcgg<br>gaagagtacgatgtgctggacaagcggcgcggccgggacccccgaaatgggcgggaagcctagaagaa<br>gaaccctcaggaaggcctgtataacgagctgcagaaggacaagatggccgaggcctactccgaaattggg<br>atgaagggagagcggcggaggggaaaggggcacgacggcctgtaccaaggactgtccaccgccaccaa<br>ggacacatacgatgccctgcacatgcaggcccttccccctcgc |
| 28 | linker | (Gly-Gly-Gly-Ser)$_n$, where n = 1-10 |
| 29 | linker | (Gly4 Ser)4 |
| 30 | linker | (Gly4 Ser)3 |
| 31 | linker | (Gly3Ser) |
| 32 | polyA | (aaaaaaaaaa)$_n$, where n = 200 |
| 33 | polyA | (aaaaaaaaaa)$_n$, where n = 15 |
| 34 | polyA | (aaaaaaaaaa)$_n$, where n = 500 |
| 35 | polyA | (tttttttttt)$_n$, where n = 10 |
| 36 | polyA | (tttttttttt)$_n$, where n = 500 |
| 37 | polyA | (aaaaaaaaaa)$_n$, where n = 500 |
| 38 | polyA | (aaaaaaaaaa)$_n$, where n = 40 |
| 39 | PD1 CAR (aa) | Pgwfldspdrpwnpptfspallvvtegdnatftcsfsntsesfvlnwyrmspsnqtdklaafpedrsqpg<br>qdcrfrvtqlpngrdfhmsvvrarrndsgtylcgaislapkaqikeslraelrvterraevptahpspsprpa<br>gqfqtlvtttpaprpptpaptiasqplslrpeacrpaaggavhtrgldfacdiyiwaplagtcgvlllslvitly<br>ckrgrkkllyifkqpfmrpvqttqeedgcscrfpeeeeggcelrvkfsrsadapaykqgqnqlynelnlgr |

TABLE 1-continued

Sequences of various components of CAR (aa—amino acids, na—nucleic acids that encodes the corresponding protein)

| SEQ ID NO | description | Sequence |
|---|---|---|
| | | reeydvldkrrgrdpemggkprrknpqeglynelqkdkmaeayseigmkgerrrgkghdglyqglst atkdtydalhmqalppr |
| 1 | CD28 costimulatory domain (aa) | RSKRSRLLHSDX$_1$MX$_2$MTPRRPGPTRKHYQPYAPPRDFAAYRS (wherein X$_1$ and X$_2$ can be any amino acid) |
| 2 | CD28 costimulatory domain (aa) | RSKRSRLLHSDYMFMTPRRPGPTRKHYQPYAPPRDFAAYRS |
| 3 | CD28 costimulatory domain (aa) | RSKRSRLLHSDFMNMTPRRPGPTRKHYQPYAPPRDFAAYRS |
| 4 | CD28 costimulatory domain (aa) | RSKRSRLLHSDFMFMTPRRPGPTRKHYQPYAPPRDFAAYRS |
| 5 | CD28 costimulatory domain (aa) | RSKRSRLLHSDYMNMTPRRPGPTRKHYQPYAPPRDFAAYRS |
| 6 | CD28 costimulatory domain (na) | aggagtaagaggagcaggctcctgcacagtgactacatgaacatgactcccgccgccccgggcccacccg caagcattaccagccctatgcccaccacgcgacttcgcagcctatcgctcc |
| 7 | CD28 costimulatory domain (na) | aggagtaagaggagcaggctcctgcacagtgactacatgttcatgactcccgccgccccgggcccaccc gcaagcattaccagccctatgcccaccacgcgacttcgcagcctatcgctcc |
| 8 | CD28 costimulatory domain (na) | aggagtaagaggagcaggctcctgcacagtgacttcatgaacatgactcccgccgccccgggcccaccc gcaagcattaccagccctatgcccaccacgcgacttcgcagcctatcgctcc |
| 9 | CD28 costimulatory domain (na) | aggagtaagaggagcaggctcctgcacagtgacttcatgttcatgactcccgccgccccgggcccacccg caagcattaccagccctatgcccaccacgcgacttcgcagcctatcgctcc |

Cancer Associated Antigens

In certain aspects, the present invention provides immune effector cells (e.g., T cells, NK cells) that are engineered to contain one or more CARs that direct the immune effector cells to cancer. This is achieved through an antigen binding domain on the CAR that is specific for a cancer associated antigen. There are two classes of cancer associated antigens (tumor antigens) that can be targeted by the CARs of the instant invention: (1) cancer associated antigens that are expressed on the surface of cancer cells; and (2) cancer associated antigens that itself is intracellar, however, a fragment of such antigen (peptide) is presented on the surface of the cancer cells by MHC (major histocompatibility complex).

Accordingly, the present invention provides CARs that target the following cancer associated antigens (tumor antigens): CD19, CD123, CD22, CD30, CD171, CS-1, CLL-1 (CLECL1), CD33, EGFRvIII, GD2, GD3, BCMA, Tn Ag, PSMA, ROR1, FLT3, FAP, TAG72, CD38, CD44v6, CEA, EPCAM, B7H3, KIT, IL-13Ra2, Mesothelin, IL-11Ra, PSCA, VEGFR2, LewisY, CD24, PDGFR-beta, PRSS21, SSEA-4, CD20, Folate receptor alpha, ERBB2 (Her2/neu), MUC1, EGFR, NCAM, Prostase, PAP, ELF2M, Ephrin B2, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, legumain, HPV E6,E7, MAGE-A1, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRLS, and IGLL1.

Tumor-Supporting Antigens

A CAR described herein can comprise an antigen binding domain (e.g., antibody or antibody fragment, TCR or TCR fragment) that binds to a tumor-supporting antigen (e.g., a tumor-supporting antigen as described herein). In some embodiments, the tumor-supporting antigen is an antigen present on a stromal cell or a myeloid-derived suppressor cell (MDSC). Stromal cells can secrete growth factors to promote cell division in the microenvironment. MDSC cells can inhibit T cell proliferation and activation. Without wishing to be bound by theory, in some embodiments, the CAR-expressing cells destroy the tumor-supporting cells, thereby indirectly inhibiting tumor growth or survival.

In embodiments, the stromal cell antigen is chosen from one or more of: bone marrow stromal cell antigen 2 (BST2), fibroblast activation protein (FAP) and tenascin. In an embodiment, the FAP-specific antibody is, competes for binding with, or has the same CDRs as, sibrotuzumab. In embodiments, the MDSC antigen is chosen from one or more of: CD33, CD11b, C14, CD15, and CD66b. Accordingly, in some embodiments, the tumor-supporting antigen is chosen from one or more of: bone marrow stromal cell antigen 2 (BST2), fibroblast activation protein (FAP) or tenascin, CD33, CD11b, C14, CD15, and CD66b.

Chimeric Antigen Receptor (CAR)

The present invention encompasses a recombinant DNA construct comprising sequences encoding a CAR, wherein the CAR comprises an antigen binding domain (e.g., antibody or antibody fragment, TCR or TCR fragment) that binds specifically to a cancer associated antigen described herein, wherein the sequence of the antigen binding domain is contiguous with and in the same reading frame as a nucleic acid sequence encoding an intracellular signaling domain. The intracellular signaling domain can comprise a costimulatory signaling domain and/or a primary signaling domain, e.g., a zeta chain. The costimulatory signaling domain refers to a portion of the CAR comprising at least a portion of the intracellular domain of a costimulatory molecule.

In specific aspects, a CAR construct of the invention comprises a scFv domain, wherein the scFv may be preceded by an optional leader sequence such as provided in SEQ ID NO: 401, and followed by an optional hinge sequence such as provided in SEQ ID NO: 403, SEQ ID NO: 405, or SEQ ID NO: 407, a transmembrane region such as provided in SEQ ID NO: 12, an intracellular signalling domain that includes SEQ ID NO:1, 2, 3, 4, or 5, and a CD3 zeta sequence that includes SEQ ID NO:18 or SEQ ID NO:20, e.g., wherein the domains are contiguous with and in the same reading frame to form a single fusion protein.

In one aspect, an exemplary CAR constructs comprise an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), and an intracellular stimulatory domain (e.g., an intracellular stimulatory domain described herein). In one aspect, an exemplary CAR construct comprises an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), an intracellular costimulatory signaling domain (e.g., a costimulatory signaling domain described herein) and/or an intracellular primary signaling domain (e.g., a primary signaling domain described herein).

An exemplary leader sequence is provided as SEQ ID NO: 401. An exemplary hinge/spacer sequence is provided as SEQ ID NO: 403, SEQ ID NO: 405, or SEQ ID NO: 407. An exemplary transmembrane domain sequence is provided as SEQ ID NO:12. An exemplary sequence of the intracellular signaling domain of CD28 is provided as SEQ ID NOs: 1-5. An exemplary CD3zeta domain sequence is provided as SEQ ID NO: 18 or SEQ ID NO: 20.

In one aspect, the present invention encompasses a recombinant nucleic acid construct comprising a nucleic acid molecule encoding a CAR, wherein the nucleic acid molecule comprises the nucleic acid sequence encoding an antigen binding domain, e.g., described herein, that is contiguous with and in the same reading frame as a nucleic acid sequence encoding an intracellular signaling domain.

In one aspect, the present invention encompasses a recombinant nucleic acid construct comprising a nucleic acid molecule encoding a CAR, wherein the nucleic acid molecule comprises a nucleic acid sequence encoding an antigen binding domain, wherein the sequence is contiguous with and in the same reading frame as the nucleic acid sequence encoding an intracellular signaling domain. An exemplary intracellular signaling domain that can be used in the CAR includes, but is not limited to, one or more intracellular signaling domains of, e.g., CD3-zeta, CD28, CD27, 4-1BB, a functional variant thereof, and the like. In some instances, the CAR can comprise any combination of CD3-zeta, CD28, 4-1BB, a functional variant thereof, and the like.

The nucleic acid sequences coding for the desired molecules can be obtained using recombinant methods known in the art, such as, for example by screening libraries from cells expressing the nucleic acid molecule, by deriving the nucleic acid molecule from a vector known to include the same, or by isolating directly from cells and tissues containing the same, using standard techniques. Alternatively, the nucleic acid of interest can be produced synthetically, rather than cloned.

The present invention includes retroviral and lentiviral vector constructs expressing a CAR that can be directly transduced into a cell.

The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-2000 bases in length (SEQ ID NO:32). RNA so produced can efficiently transfect different kinds of cells. In one embodiment, the template includes sequences for the CAR. In an embodiment, an RNA CAR vector is transduced into a cell, e.g., a T cell or a NK cell, by electroporation.

Antigen Binding Domain

In one aspect, the CAR of the invention comprises a target-specific binding element otherwise referred to as an antigen binding domain. The choice of moiety depends upon the type and number of ligands that define the surface of a target cell. For example, the antigen binding domain may be chosen to recognize a ligand that acts as a cell surface marker on target cells associated with a particular disease state. Thus, examples of cell surface markers that may act as ligands for the antigen binding domain in a CAR of the invention include those associated with viral, bacterial and parasitic infections, autoimmune disease and cancer cells.

In one aspect, the CAR-mediated T-cell response can be directed to an antigen of interest by way of engineering an antigen binding domain that specifically binds a desired antigen into the CAR.

In one aspect, the portion of the CAR comprising the antigen binding domain comprises an antigen binding domain that targets a tumor antigen, e.g., a tumor antigen described herein.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

In one embodiment, an antigen binding domain against CD22 is an antigen binding portion, e.g., CDRs, of an antibody described in, e.g., Haso et al., Blood, 121(7): 1165-1174 (2013); Wayne et al., Clin Cancer Res 16(6): 1894-1903 (2010); Kato et al., Leuk Res 37(1):83-88 (2013); Creative BioMart (creativebiomart.net): MOM-18047-S(P).

In one embodiment, an antigen binding domain against CS-1 is an antigen binding portion, e.g., CDRs, of Elotuzumab (BMS), see e.g., Tai et al., 2008, Blood 112(4): 1329-37; Tai et al., 2007, Blood. 110(5):1656-63.

In one embodiment, an antigen binding domain against CLL-1 is an antigen binding portion, e.g., CDRs, of an antibody available from R&D, ebiosciences, Abcam, for example, PE-CLL1-hu Cat #353604 (BioLegend); and PE-CLL1 (CLEC12A) Cat #562566 (BD).

In one embodiment, an antigen binding domain against CD33 is an antigen binding portion, e.g., CDRs, of an antibody described in, e.g., Bross et al., Clin Cancer Res 7(6):1490-1496 (2001) (Gemtuzumab Ozogamicin, hP67.6), Caron et al., Cancer Res 52(24):6761-6767 (1992) (Lintuzumab, HuM195), Lapusan et al., Invest New Drugs 30(3):1121-1131 (2012) (AVE9633), Aigner et al., Leukemia 27(5): 1107-1115 (2013) (AMG330, CD33 BiTE), Dutour et al., Adv hematol 2012:683065 (2012), and Pizzitola et al., Leukemia doi:10.1038/Lue.2014.62 (2014).

In one embodiment, an antigen binding domain against GD2 is an antigen binding portion, e.g., CDRs, of an antibody described in, e.g., Mujoo et al., Cancer Res. 47(4):1098-1104 (1987); Cheung et al., Cancer Res 45(6): 2642-2649 (1985), Cheung et al., J Clin Oncol 5(9):1430-1440 (1987), Cheung et al., J Clin Oncol 16(9):3053-3060 (1998), Handgretinger et al., Cancer Immunol Immunother 35(3):199-204 (1992). In some embodiments, an antigen binding domain against GD2 is an antigen binding portion of an antibody selected from mAb 14.18, 14G2a, ch14.18, hu14.18, 3F8, hu3F8, 3G6, 8B6, 60C3, 10B8, ME36.1, and 8H9, see e.g., WO2012033885, WO2013040371, WO2013192294, WO2013061273, WO2013123061, WO2013074916, and WO201385552. In some embodiments, an antigen binding domain against GD2 is an antigen binding portion of an antibody described in US Publication No.: 20100150910 or PCT Publication No.: WO 2011160119.

In one embodiment, an antigen binding domain against BCMA is an antigen binding portion, e.g., CDRs, of an antibody described in, e.g., WO2012163805, WO200112812, and WO2003062401.

In one embodiment, an antigen binding domain against Tn antigen is an antigen binding portion, e.g., CDRs, of an antibody described in, e.g., U.S. Pat. No. 8,440,798, Brooks et al., PNAS 107(22):10056-10061 (2010), and Stone et al., OncoImmunology 1(6):863-873(2012).

In one embodiment, an antigen binding domain against PSMA is an antigen binding portion, e.g., CDRs, of an antibody described in, e.g., Parker et al., Protein Expr Purif 89(2):136-145 (2013), US 20110268656 (J591 ScFv); Frigerio et al, European J Cancer 49(9):2223-2232 (2013) (scFvD2B); WO 2006125481 (mAbs 3/A12, 3/E7 and 3/F11) and single chain antibody fragments (scFv A5 and D7).

In one embodiment, an antigen binding domain against ROR1 is an antigen binding portion, e.g., CDRs, of an antibody described in, e.g., Hudecek et al., Clin Cancer Res 19(12):3153-3164 (2013); WO 2011159847; and US20130101607.

In one embodiment, an antigen binding domain against FLT3 is an antigen binding portion, e.g., CDRs, of an antibody described in, e.g., WO2011076922, U.S. Pat. No. 5,777,084, EP0754230, US20090297529, and several commercial catalog antibodies (R&D, ebiosciences, Abcam).

In one embodiment, an antigen binding domain against TAG72 is an antigen binding portion, e.g., CDRs, of an antibody described in, e.g., Hombach et al., Gastroenterology 113(4):1163-1170 (1997); and Abcam ab691.

In one embodiment, an antigen binding domain against FAP is an antigen binding portion, e.g., CDRs, of an antibody described in, e.g., Ostermann et al., Clinical Cancer Research 14:4584-4592 (2008) (FAPS), US Pat. Publication No. 2009/0304718; sibrotuzumab (see e.g., Hofheinz et al., Oncology Research and Treatment 26(1), 2003); and Tran et al., J Exp Med 210(6):1125-1135 (2013).

In one embodiment, an antigen binding domain against CD38 is an antigen binding portion, e.g., CDRs, of daratumumab (see, e.g., Groen et al., Blood 116(21):1261-1262 (2010); MOR202 (see, e.g., U.S. Pat. No. 8,263,746); or antibodies described in U.S. Pat. No. 8,362,211.

In one embodiment, an antigen binding domain against CD44v6 is an antigen binding portion, e.g., CDRs, of an antibody described in, e.g., Casucci et al., Blood 122(20): 3461-3472 (2013).

In one embodiment, an antigen binding domain against CEA is an antigen binding portion, e.g., CDRs, of an antibody described in, e.g., Chmielewski et al., Gastoenterology 143(4):1095-1107 (2012).

In one embodiment, an antigen binding domain against EPCAM is an antigen binding portion, e.g., CDRS, of an antibody selected from MT110, EpCAM-CD3 bispecific Ab (see, e.g., clinicaltrials.gov/ct2/show/NCT00635596); Edrecolomab; 3622W94; ING-1; and adecatumumab (MT201).

In one embodiment, an antigen binding domain against PRSS21 is an antigen binding portion, e.g., CDRs, of an antibody described in U.S. Pat. No. 8,080,650.

In one embodiment, an antigen binding domain against B7H3 is an antigen binding portion, e.g., CDRs, of an antibody MGA271 (Macrogenics).

In one embodiment, an antigen binding domain against KIT is an antigen binding portion, e.g., CDRs, of an antibody described in, e.g., U.S. Pat. No. 7,915,391, US20120288506, and several commercial catalog antibodies.

In one embodiment, an antigen binding domain against IL-13Ra2 is an antigen binding portion, e.g., CDRs, of an antibody described in, e.g., WO2008/146911, WO2004087758, several commercial catalog antibodies, and WO2004087758.

In one embodiment, an antigen binding domain against CD30 is an antigen binding portion, e.g., CDRs, of an antibody described in, e.g., U.S. Pat. No. 7,090,843 B1, and EP0805871.

In one embodiment, an antigen binding domain against GD3 is an antigen binding portion, e.g., CDRs, of an antibody described in, e.g., U.S. Pat. Nos. 7,253,263; 8,207,308; US 20120276046; EP1013761; WO2005035577; and U.S. Pat. No. 6,437,098.

In one embodiment, an antigen binding domain against CD171 is an antigen binding portion, e.g., CDRs, of an antibody described in, e.g., Hong et al., J Immunother 37(2):93-104 (2014).

In one embodiment, an antigen binding domain against IL-11Ra is an antigen binding portion, e.g., CDRs, of an antibody available from Abcam (cat #ab55262) or Novus Biologicals (cat #EPR5446). In another embodiment, an antigen binding domain again IL-11Ra is a peptide, see, e.g., Huang et al., Cancer Res 72(1):271-281 (2012).

In one embodiment, an antigen binding domain against PSCA is an antigen binding portion, e.g., CDRs, of an antibody described in, e.g., Morgenroth et al., Prostate 67(10):1121-1131 (2007) (scFv 7F5); Nejatollahi et al., J of Oncology 2013(2013), article ID 839831 (scFv C5-II); and US Pat Publication No. 20090311181.

In one embodiment, an antigen binding domain against VEGFR2 is an antigen binding portion, e.g., CDRs, of an antibody described in, e.g., Chinnasamy et al., J Clin Invest 120(11):3953-3968 (2010).

In one embodiment, an antigen binding domain against LewisY is an antigen binding portion, e.g., CDRs, of an antibody described in, e.g., Kelly et al., Cancer Biother Radiopharm 23(4):411-423 (2008) (hu3S193 Ab (scFvs)); Dolezal et al., Protein Engineering 16(1):47-56 (2003) (NC10 scFv).

In one embodiment, an antigen binding domain against CD24 is an antigen binding portion, e.g., CDRs, of an antibody described in, e.g., Maliar et al., Gastroenterology 143(5):1375-1384 (2012).

In one embodiment, an antigen binding domain against PDGFR-beta is an antigen binding portion, e.g., CDRs, of an antibody Abcam ab32570.

In one embodiment, an antigen binding domain against SSEA-4 is an antigen binding portion, e.g., CDRs, of antibody MC813 (Cell Signaling), or other commercially available antibodies.

In one embodiment, an antigen binding domain against CD20 is an antigen binding portion, e.g., CDRs, of the antibody Rituximab, Ofatumumab, Ocrelizumab, Veltuzumab, or GA101.

In one embodiment, an antigen binding domain against Folate receptor alpha is an antigen binding portion, e.g., CDRs, of the antibody IMGN853, or an antibody described in US20120009181; U.S. Pat. No. 4,851,332, LK26: U.S. Pat. No. 5,952,484.

In one embodiment, an antigen binding domain against ERBB2 (Her2/neu) is an antigen binding portion, e.g., CDRs, of the antibody trastuzumab, or pertuzumab.

In one embodiment, an antigen binding domain against MUC1 is an antigen binding portion, e.g., CDRs, of the antibody SAR566658.

In one embodiment, the antigen binding domain against EGFR is antigen binding portion, e.g., CDRs, of the antibody cetuximab, panitumumab, zalutumumab, nimotuzumab, or matuzumab.

In one embodiment, an antigen binding domain against NCAM is an antigen binding portion, e.g., CDRs, of the antibody clone 2-2B: MAB5324 (EMD Millipore)

In one embodiment, an antigen binding domain against Ephrin B2 is an antigen binding portion, e.g., CDRs, of an antibody described in, e.g., Abengozar et al., Blood 119(19): 4565-4576 (2012).

In one embodiment, an antigen binding domain against IGF-I receptor is an antigen binding portion, e.g., CDRs, of an antibody described in, e.g., U.S. Pat. No. 8,344,112 B2; EP2322550 A1; WO 2006/138315, or PCT/US2006/022995.

In one embodiment, an antigen binding domain against CAIX is an antigen binding portion, e.g., CDRs, of the antibody clone 303123 (R&D Systems).

In one embodiment, an antigen binding domain against LMP2 is an antigen binding portion, e.g., CDRs, of an antibody described in, e.g., U.S. Pat. No. 7,410,640, or US20050129701.

In one embodiment, an antigen binding domain against gp100 is an antigen binding portion, e.g., CDRs, of the antibody HMB45, NKIbetaB, or an antibody described in WO2013165940, or US20130295007

In one embodiment, an antigen binding domain against tyrosinase is an antigen binding portion, e.g., CDRs, of an antibody described in, e.g., U.S. Pat. No. 5,843,674; or US19950504048.

In one embodiment, an antigen binding domain against EphA2 is an antigen binding portion, e.g., CDRs, of an antibody described in, e.g., Yu et al., Mol Ther 22(1):102-111 (2014).

In one embodiment, an antigen binding domain against GD3 is an antigen binding portion, e.g., CDRs, of an antibody described in, e.g., U.S. Pat. Nos. 7,253,263; 8,207,308; US 20120276046; EP1013761 A3; 20120276046; WO2005035577; or U.S. Pat. No. 6,437,098.

In one embodiment, an antigen binding domain against fucosyl GM1 is an antigen binding portion, e.g., CDRs, of an antibody described in, e.g., US20100297138; or WO2007/067992.

In one embodiment, an antigen binding domain against sLe is an antigen binding portion, e.g., CDRs, of the antibody G193 (for lewis Y), see Scott A M et al, Cancer Res 60: 3254-61 (2000), also as described in Neeson et al, J Immunol May 2013 190 (Meeting Abstract Supplement) 177.10.

In one embodiment, an antigen binding domain against GM3 is an antigen binding portion, e.g., CDRs, of the antibody CA 2523449 (mAb 14F7).

In one embodiment, an antigen binding domain against HMWMAA is an antigen binding portion, e.g., CDRs, of an antibody described in, e.g., Kmiecik et al., Oncoimmunology 3(1):e27185 (2014) (PMID: 24575382) (mAb9.2.27); U.S. Pat. No. 6,528,481; WO2010033866; or US 20140004124.

In one embodiment, an antigen binding domain against o-acetyl-GD2 is an antigen binding portion, e.g., CDRs, of the antibody 8B6.

In one embodiment, an antigen binding domain against TEM1/CD248 is an antigen binding portion, e.g., CDRs, of an antibody described in, e.g., Marty et al., Cancer Lett 235(2):298-308 (2006); Zhao et al., J Immunol Methods 363(2):221-232 (2011).

In one embodiment, an antigen binding domain against CLDN6 is an antigen binding portion, e.g., CDRs, of the antibody IMAB027 (Ganymed Pharmaceuticals), see e.g., clinicaltrial.gov/show/NCT02054351.

In one embodiment, an antigen binding domain against TSHR is an antigen binding portion, e.g., CDRs, of an antibody described in, e.g., U.S. Pat. Nos. 8,603,466; 8,501,415; or U.S. Pat. No. 8,309,693.

In one embodiment, an antigen binding domain against GPRCSD is an antigen binding portion, e.g., CDRs, of the antibody FAB6300A (R&D Systems); or LS-A4180 (Lifespan Biosciences).

In one embodiment, an antigen binding domain against CD97 is an antigen binding portion, e.g., CDRs, of an antibody described in, e.g., U.S. Pat. No. 6,846,911; de Groot et al., J Immunol 183(6):4127-4134 (2009); or an antibody from R&D:MAB3734.

In one embodiment, an antigen binding domain against ALK is an antigen binding portion, e.g., CDRs, of an antibody described in, e.g., Mino-Kenudson et al., Clin Cancer Res 16(5):1561-1571 (2010).

In one embodiment, an antigen binding domain against polysialic acid is an antigen binding portion, e.g., CDRs, of an antibody described in, e.g., Nagae et al., J Biol Chem 288(47):33784-33796 (2013).

In one embodiment, an antigen binding domain against PLAC1 is an antigen binding portion, e.g., CDRs, of an antibody described in, e.g., Ghods et al., Biotechnol Appl Biochem 2013 doi:10.1002/bab.1177.

In one embodiment, an antigen binding domain against GloboH is an antigen binding portion of the antibody VK9; or an antibody described in, e.g., Kudryashov V et al, Glycoconj J.15(3):243-9 (1998), Lou et al., Proc Natl Acad Sci USA 111(7):2482-2487 (2014); MBr1: Bremer E-G et al. J Biol Chem 259:14773-14777 (1984).

In one embodiment, an antigen binding domain against NY-BR-1 is an antigen binding portion, e.g., CDRs of an antibody described in, e.g., Jager et al., Appl Immunohistochem Mol Morphol 15(1):77-83 (2007).

In one embodiment, an antigen binding domain against WT-1 is an antigen binding portion, e.g., CDRs, of an antibody described in, e.g., Dao et al., Sci Transl Med 5(176):176ra33 (2013); or WO2012/135854.

In one embodiment, an antigen binding domain against MAGE-A1 is an antigen binding portion, e.g., CDRs, of an antibody described in, e.g., Willemsen et al., J Immunol 174(12):7853-7858 (2005) (TCR-like scFv).

In one embodiment, an antigen binding domain against sperm protein 17 is an antigen binding portion, e.g., CDRs, of an antibody described in, e.g., Song et al., Target Oncol 2013 Aug. 14 (PMID: 23943313); Song et al., Med Oncol 29(4):2923-2931 (2012).

In one embodiment, an antigen binding domain against Tie 2 is an antigen binding portion, e.g., CDRs, of the antibody AB33 (Cell Signaling Technology).

In one embodiment, an antigen binding domain against MAD-CT-2 is an antigen binding portion, e.g., CDRs, of an antibody described in, e.g., PMID: 2450952; U.S. Pat. No. 7,635,753.

In one embodiment, an antigen binding domain against Fos-related antigen 1 is an antigen binding portion, e.g., CDRs, of the antibody 12F9 (Novus Biologicals).

In one embodiment, an antigen binding domain against MelanA/MART1 is an antigen binding portion, e.g., CDRs, of an antibody described in, EP2514766 A2; or U.S. Pat. No. 7,749,719.

In one embodiment, an antigen binding domain against sarcoma translocation breakpoints is an antigen binding portion, e.g., CDRs, of an antibody described in, e.g., Luo et al, EMBO Mol. Med. 4(6):453-461 (2012).

In one embodiment, an antigen binding domain against TRP-2 is an antigen binding portion, e.g., CDRs, of an antibody described in, e.g., Wang et al, J Exp Med. 184(6): 2207-16 (1996).

In one embodiment, an antigen binding domain against CYP1B1 is an antigen binding portion, e.g., CDRs, of an antibody described in, e.g., Maecker et al, Blood 102 (9): 3287-3294 (2003).

In one embodiment, an antigen binding domain against RAGE-1 is an antigen binding portion, e.g., CDRs, of the antibody MAB5328 (EMD Millipore).

In one embodiment, an antigen binding domain against human telomerase reverse transcriptase is an antigen binding portion, e.g., CDRs, of the antibody cat no: LS-B95-100 (Lifespan Biosciences)

In one embodiment, an antigen binding domain against intestinal carboxyl esterase is an antigen binding portion, e.g., CDRs, of the antibody 4F12: cat no: LS-B6190-50 (Lifespan Biosciences).

In one embodiment, an antigen binding domain against mut hsp70-2 is an antigen binding portion, e.g., CDRs, of the antibody Lifespan Biosciences: monoclonal: cat no: LS-C133261-100 (Lifespan Biosciences).

In one embodiment, an antigen binding domain against CD79a is an antigen binding portion, e.g., CDRs, of the antibody Anti-CD79a antibody [HM47/A9] (ab3121), available from Abcam; antibody CD79A Antibody #3351 available from Cell Signalling Technology; or antibody HPA017748—Anti-CD79A antibody produced in rabbit, available from Sigma Aldrich.

In one embodiment, an antigen binding domain against CD79b is an antigen binding portion, e.g., CDRs, of the antibody polatuzumab vedotin, anti-CD79b described in Dornan et al., "Therapeutic potential of an anti-CD79b antibody-drug conjugate, anti-CD79b-vc-MMAE, for the treatment of non-Hodgkin lymphoma" Blood. 2009 Sep. 24; 114(13):2721-9. doi: 10.1182/blood-2009-02-205500. Epub 2009 Jul. 24, or the bispecific antibody Anti-CD79b/CD3 described in "4507 Pre-Clinical Characterization of T Cell-Dependent Bispecific Antibody Anti-CD79b/CD3 As a Potential Therapy for B Cell Malignancies" Abstracts of 56$^{th}$ ASH Annual Meeting and Exposition, San Francisco, Calif. Dec. 6-9 2014.

In one embodiment, an antigen binding domain against CD72 is an antigen binding portion, e.g., CDRs, of the antibody J3-109 described in Myers, and Uckun, "An anti-CD72 immunotoxin against therapy-refractory B-lineage acute lymphoblastic leukemia." Leuk Lymphoma. 1995 June; 18(1-2):119-22, or anti-CD72 (10D6.8.1, mIgG1) described in Polson et al., "Antibody-Drug Conjugates for the Treatment of Non-Hodgkin's Lymphoma: Target and Linker-Drug Selection" Cancer Res Mar. 15, 2009 69; 2358.

In one embodiment, an antigen binding domain against LAIR1 is an antigen binding portion, e.g., CDRs, of the antibody ANT-301 LAIR1 antibody, available from ProSpec; or anti-human CD305 (LAIR1) Antibody, available from BioLegend.

In one embodiment, an antigen binding domain against FCAR is an antigen binding portion, e.g., CDRs, of the antibody CD89/FCAR Antibody (Catalog #10414-H08H), available from Sino Biological Inc.

In one embodiment, an antigen binding domain against LILRA2 is an antigen binding portion, e.g., CDRs, of the antibody LILRA2 monoclonal antibody (M17), clone 3C7, available from Abnova, or Mouse Anti-LILRA2 antibody, Monoclonal (2D7), available from Lifespan Biosciences.

In one embodiment, an antigen binding domain against CD300LF is an antigen binding portion, e.g., CDRs, of the antibody Mouse Anti-CMRF35-like molecule 1 antibody, Monoclonal[UP-D2], available from BioLegend, or Rat Anti-CMRF35-like molecule 1 antibody, Monoclonal [234903], available from R&D Systems.

In one embodiment, an antigen binding domain against CLEC12A is an antigen binding portion, e.g., CDRs, of the antibody Bispecific T cell Engager (BiTE) scFv-antibody and ADC described in Noordhuis et al., "Targeting of CLEC12A In Acute Myeloid Leukemia by Antibody-Drug-Conjugates and Bispecific CLL-1xCD3 BiTE Antibody" $53^{rd}$ ASH Annual Meeting and Exposition, Dec. 10-13, 2011, and MCLA-117 (Merus).

In one embodiment, an antigen binding domain against BST2 (also called CD317) is an antigen binding portion, e.g., CDRs, of the antibody Mouse Anti-CD317 antibody, Monoclonal[3H4], available from Antibodies-Online or Mouse Anti-CD317 antibody, Monoclonal[696739], available from R&D Systems.

In one embodiment, an antigen binding domain against EMR2 (also called CD312) is an antigen binding portion, e.g., CDRs, of the antibody Mouse Anti-CD312 antibody, Monoclonal[LS-B8033] available from Lifespan Biosciences, or Mouse Anti-CD312 antibody, Monoclonal [494025] available from R&D Systems.

In one embodiment, an antigen binding domain against LY75 is an antigen binding portion, e.g., CDRs, of the antibody Mouse Anti-Lymphocyte antigen 75 antibody, Monoclonal[HD30] available from EMD Millipore or Mouse Anti-Lymphocyte antigen 75 antibody, Monoclonal [A15797] available from Life Technologies.

In one embodiment, an antigen binding domain against GPC3 is an antigen binding portion, e.g., CDRs, of the antibody hGC33 described in Nakano K, Ishiguro T, Konishi H, et al. Generation of a humanized anti-glypican 3 antibody by CDR grafting and stability optimization. Anticancer Drugs. 2010 November; 21(10):907-916, or MDX-1414, HN3, or YP7, all three of which are described in Feng et al., "Glypican-3 antibodies: a new therapeutic target for liver cancer." FEBS Lett. 2014 Jan. 21; 588(2):377-82.

In one embodiment, an antigen binding domain against FCRL5 is an antigen binding portion, e.g., CDRs, of the anti-FcRL5 antibody described in Elkins et al., "FcRL5 as a target of antibody-drug conjugates for the treatment of multiple myeloma" Mol Cancer Ther. 2012 October; 11(10): 2222-32.

In one embodiment, an antigen binding domain against IGLL1 is an antigen binding portion, e.g., CDRs, of the antibody Mouse Anti-Immunoglobulin lambda-like polypeptide 1 antibody, Monoclonal[AT1G4] available from Lifespan Biosciences, Mouse Anti-Immunoglobulin lambda-like polypeptide 1 antibody, Monoclonal[HSL11] available from BioLegend.

In one embodiment, the antigen binding domain comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed above.

In another aspect, the antigen binding domain comprises a humanized antibody or an antibody fragment. In some aspects, a non-human antibody is humanized, where specific sequences or regions of the antibody are modified to increase similarity to an antibody naturally produced in a human or fragment thereof. In one aspect, the antigen binding domain is humanized.

A humanized antibody can be produced using a variety of techniques known in the art, including but not limited to, CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16):10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994), each of which is incorporated herein in its entirety by reference. Often, framework residues in the framework regions will be substituted with the corresponding residue from the CDR donor antibody to alter, for example improve, antigen binding. These framework substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323, which are incorporated herein by reference in their entireties.)

A humanized antibody or antibody fragment has one or more amino acid residues remaining in it from a source which is nonhuman. These nonhuman amino acid residues are often referred to as "import" residues, which are typically taken from an "import" variable domain. As provided herein, humanized antibodies or antibody fragments comprise one or more CDRs from nonhuman immunoglobulin molecules and framework regions wherein the amino acid residues comprising the framework are derived completely or mostly from human germline. Multiple techniques for humanization of antibodies or antibody fragments are well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530, 101; 5,585,089; 6,548,640, the contents of which are incorporated herein by reference herein in their entirety). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference herein in their entirety.

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987), the contents of which are incorporated herein by reference herein in their entirety). Another method uses a particular framework derived from the consensus sequence of all human antibodies of a particular subgroup of light or heavy chains. The same framework may be used for several different humanized antibodies (see, e.g., Nicholson et al. Mol. Immun 34 (16-17): 1157-1165 (1997); Carter et al., Proc. Natl. Acad. Sci. USA, 89:4285 (1992); Presta et al., J. Immunol., 151:2623 (1993), the contents of which are incorporated herein by reference herein in their entirety). In some embodiments, the framework region, e.g., all four framework regions, of the heavy chain variable region are derived from a VH4_4-59 germline sequence. In one embodiment, the framework region can comprise, one, two, three, four or five modifications, e.g., substitutions, e.g., from the amino acid at the corresponding murine sequence. In one embodiment, the framework region, e.g., all four framework regions of the light chain variable region are derived from a VK3_1.25 germline sequence. In one embodiment, the framework region can comprise, one, two, three, four or five modifications, e.g., substitutions, e.g., from the amino acid at the corresponding murine sequence.

In some aspects, the portion of a CAR composition of the invention that comprises an antibody fragment is humanized with retention of high affinity for the target antigen and other favorable biological properties. According to one aspect of the invention, humanized antibodies and antibody fragments are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, e.g., the analysis of residues that influence the ability of the candidate immunoglobulin to bind the target antigen. In this way, FR residues can be selected and combined from the recipient and import sequences so that the desired antibody or antibody fragment characteristic, such as increased affinity for the target antigen, is achieved. In general, the CDR residues are directly and most substantially involved in influencing antigen binding.

A humanized antibody or antibody fragment may retain a similar antigenic specificity as the original antibody, e.g., in the present invention, the ability to bind human a cancer associated antigen as described herein. In some embodiments, a humanized antibody or antibody fragment may have improved affinity and/or specificity of binding to human a cancer associated antigen as described herein.

In one aspect, the antigen binding domain of the invention is characterized by particular functional features or properties of an antibody or antibody fragment. For example, in one aspect, the portion of a CAR composition of the invention that comprises an antigen binding domain specifically binds a tumor antigen as described herein.

In one aspect, the anti-cancer associated antigen as described herein binding domain is a fragment, e.g., a single chain variable fragment (scFv). In one aspect, the anti-cancer associated antigen as described herein binding domain is a Fv, a Fab, a (Fab')2, or a bifunctional (e.g. bi-specific) hybrid antibody (e.g., Lanzavecchia et al., Eur. J. Immunol. 17, 105 (1987)). In one aspect, the antibodies and fragments thereof of the invention binds a cancer associated antigen as described herein protein with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as $(Gly_4Ser)n$, where n is a positive integer equal to or greater than 1 (SEQ ID NO:22). In one embodiment, the linker can be $(Gly_4Ser)_4$ (SEQ ID NO:29) or $(Gly_4Ser)_3$ (SEQ ID NO:30). Variation in the linker length may retain or enhance activity, giving rise to superior efficacy in activity studies.

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Vα and Vβ genes from a T cell clone linked by a linker (e.g., a flexible peptide). This approach is very useful to cancer associated target that itself is intracellar, however, a fragment of such antigen (peptide) is presented on the surface of the cancer cells by MHC.

In one embodiment, an antigen binding domain against EGFRvIII is an antigen binding portion, e.g., CDRs, of a CAR, antibody or antigen-binding fragment thereof described in, e.g., PCT publication WO2014/130657 or US2014/0322275A1. In one embodiment, the CAR molecule comprises an EGFRvIII CAR, or an antigen binding domain according to Table 2 or SEQ ID NO:11 of WO 2014/130657, incorporated herein by reference, or a sequence substantially identical thereto (e.g., at least 85%, 90%, 95% or more identical thereto). The amino acid and nucleotide sequences encoding the EGFRvIII CAR molecules and antigen binding domains (e.g., including one, two, three VH CDRs; and one, two, three VL CDRs according to Kabat or Chothia), are specified in WO 2014/130657.

In one embodiment, an antigen binding domain against mesothelin is an antigen binding portion, e.g., CDRs, of an antibody, antigen-binding fragment or CAR described in, e.g., PCT publication WO2015/090230. In one embodiment, an antigen binding domain against mesothelin is an antigen binding portion, e.g., CDRs, of an antibody, antigen-binding fragment, or CAR described in, e.g., PCT publication WO1997/025068, WO1999/028471, WO2005/014652, WO2006/099141, WO2009/045957, WO2009/068204, WO2013/142034, WO2013/040557, or WO2013/063419.

In an embodiment, the CAR molecule comprises a mesothelin CAR described herein, e.g., a mesothelin CAR described in WO 2015/090230, incorporated herein by reference. In embodiments, the mesothelin CAR comprises an amino acid, or has a nucleotide sequence shown in WO 2015/090230 incorporated herein by reference, or a sequence substantially identical to any of the aforesaid sequences (e.g., at least 85%, 90%, 95% or more identical to any of the aforesaid mesothelin CAR sequences). In one embodiment, the CAR molecule comprises a mesothelin CAR, or an antigen binding domain according to Tables 2-3 of WO 2015/090230, incorporated herein by reference, or a sequence substantially identical thereto (e.g., at least 85%, 90%, 95% or more identical thereto). The amino acid and nucleotide sequences encoding the mesothelin CAR molecules and antigen binding domains (e.g., including one, two, three VH CDRs; and one, two, three VL CDRs according to Kabat or Chothia), are specified in WO 2015/090230.

In one embodiment, an antigen binding domain against CD123 is an antigen binding portion, e.g., CDRs, of an antibody, antigen-binding fragment or CAR described in, e.g., PCT publication WO2016/028896. In one embodiment, an antigen binding domain against CD123 is an antigen binding portion, e.g., CDRs, of an antibody, antigen-binding fragment or CAR described in, e.g., PCT publication WO2014/130635. In one embodiment, an antigen binding domain against CD123 is an antigen binding portion, e.g., CDRs, of an antibody, antigen-binding fragment, or CAR described in, e.g., PCT publication WO2014/138805, WO2014/138819, WO2013/173820, WO2014/144622, WO2001/66139, WO2010/126066, WO2014/144622, or US2009/0252742.

In one embodiment, an antigen binding domain against CD123 is an antigen binding portion, e.g., CDRs, of an antibody, antigen-binding fragment or CAR described in, e.g., US2014/0322212A1 or US2016/0068601A1, both incorporated herein by reference. In embodiments, the CD123 CAR comprises an amino acid, or has a nucleotide sequence shown in US2014/0322212A1 or US2016/0068601A1, both incorporated herein by reference, or a sequence substantially identical to any of the aforesaid sequences (e.g., at least 85%, 90%, 95% or more identical to any of the aforesaid CD123 CAR sequences). In one embodiment, the CAR molecule comprises a CD123 CAR (e.g., any of the CAR1-CAR8), or an antigen binding domain according to Tables 1-2 of WO 2014/130635, incorporated herein by reference, or a sequence substantially identical thereto (e.g., at least 85%, 90%, 95% or more identical to any of the aforesaid CD123 CAR sequences). The amino acid and nucleotide sequences encoding the CD123 CAR molecules and antigen binding domains (e.g., including one, two, three VH CDRs; and one, two, three VL CDRs according to Kabat or Chothia), are specified in WO 2014/130635.

In other embodiments, the CAR molecule comprises a CD123 CAR comprises a CAR molecule (e.g., any of the CAR123-1 to CAR123-4 and hzCAR123-1 to hzCAR123-32), or an antigen binding domain according to Tables 2, 6, and 9 of WO2016/028896, incorporated herein by reference, or a sequence substantially identical thereto (e.g., at least 85%, 90%, 95% or more identical to any of the aforesaid CD123 CAR sequences). The amino acid and nucleotide sequences encoding the CD123 CAR molecules and antigen binding domains (e.g., including one, two, three VH CDRs; and one, two, three VL CDRs according to Kabat or Chothia), are specified in WO2016/028896.

In one embodiment, an antigen binding domain against CD22 is an antigen binding portion, e.g., CDRs, of an antibody described in, e.g., Haso et al., Blood, 121(7): 1165-1174 (2013); Wayne et al., Clin Cancer Res 16(6): 1894-1903 (2010); Kato et al., Leuk Res 37(1):83-88 (2013); Creative BioMart (creativebiomart.net): MOM-18047-S(P).

In one embodiment, an antigen binding domain against CS-1 is an antigen binding portion, e.g., CDRs, of Elotuzumab (BMS), see e.g., Tai et al., 2008, Blood 112(4): 1329-37; Tai et al., 2007, Blood. 110(5):1656-63.

In one embodiment, an antigen binding domain against CLL-1 is an antigen binding portion, e.g., CDRs, of an antibody available from R&D, ebiosciences, Abcam, for example, PE-CLL1-hu Cat #353604 (BioLegend); and PE-CLL1 (CLEC12A) Cat #562566 (BD).

In other embodiments, the CLL1 CAR includes a CAR molecule, or an antigen binding domain according to Table 2 of WO2016/014535, incorporated herein by reference. The amino acid and nucleotide sequences encoding the CLL-1 CAR molecules and antigen binding domains (e.g., including one, two, three VH CDRs; and one, two, three VL CDRs according to Kabat or Chothia), are specified in WO2016/014535.

In one embodiment, an antigen binding domain against CD33 is an antigen binding portion, e.g., CDRs, of an antibody described in, e.g., Bross et al., Clin Cancer Res 7(6):1490-1496 (2001) (Gemtuzumab Ozogamicin, hP67.6), Caron et al., Cancer Res 52(24):6761-6767 (1992) (Lintuzumab, HuM195), Lapusan et al., Invest New Drugs 30(3):1121-1131 (2012) (AVE9633), Aigner et al., Leukemia 27(5): 1107-1115 (2013) (AMG330, CD33 BiTE), Dutour et al., Adv hematol 2012:683065 (2012), and Pizzitola et al., Leukemia doi:10.1038/Lue.2014.62 (2014).

In one embodiment, an antigen binding domain against CD33 is an antigen binding portion, e.g., CDRs, of an antibody described in, US2016/0096892A1, incorporated herein by reference. In embodiments, the CD33 CAR comprises an amino acid, or has a nucleotide sequence shown in US2016/0096892A1, incorporated herein by reference, or a sequence substantially identical to any of the aforesaid sequences (e.g., at least 85%, 90%, 95% or more identical to any of the aforesaid CD33 CAR sequences). In other embodiments, the CD33 CAR CAR or antigen binding domain thereof can include a CAR molecule (e.g., any of CAR33-1 to CAR-33-9), or an antigen binding domain according to Table 2 or 9 of WO2016/014576, incorporated herein by reference, or a sequence substantially identical to any of the aforesaid sequences (e.g., at least 85%, 90%, 95% or more identical to any of the aforesaid CD33 CAR sequences). The amino acid and nucleotide sequences encoding the CD33 CAR molecules and antigen binding domains (e.g., including one, two, three VH CDRs; and one, two, three VL CDRs according to Kabat or Chothia), are specified in WO2016/014576.

In one embodiment, an antigen binding domain against GD2 is an antigen binding portion, e.g., CDRs, of an antibody described in, e.g., Mujoo et al., Cancer Res. 47(4):1098-1104 (1987); Cheung et al., Cancer Res 45(6): 2642-2649 (1985), Cheung et al., J Clin Oncol 5(9):1430-1440 (1987), Cheung et al., J Clin Oncol 16(9):3053-3060 (1998), Handgretinger et al., Cancer Immunol Immunother 35(3):199-204 (1992). In some embodiments, an antigen binding domain against GD2 is an antigen binding portion of an antibody selected from mAb 14.18, 14G2a, ch14.18, hu14.18, 3F8, hu3F8, 3G6, 8B6, 60C3, 10B8, ME36.1, and 8H9, see e.g., WO2012033885, WO2013040371, WO2013192294, WO2013061273, WO2013123061, WO2013074916, and WO201385552. In some embodiments, an antigen binding domain against GD2 is an antigen binding portion of an antibody described in US Publication No.: 20100150910 or PCT Publication No.: WO 2011160119.

In one embodiment, an antigen binding domain against BCMA is an antigen binding portion, e.g., CDRs, of an antibody, antigen-binding fragment or CAR described in, e.g., PCT publication WO2016/014565, e.g., the antigen binding portion of CAR BCMA-10 as described in WO2016/014565. In one embodiment, an antigen binding domain against BCMA is an antigen binding portion, e.g., CDRs, of an antibody, antigen-binding fragment or CAR described in, e.g., PCT publication WO2016/014789. In one embodiment, an antigen binding domain against BCMA is an antigen binding portion, e.g., CDRs, of an antibody described in, e.g., WO2012/163805, WO2001/12812, and WO2003/062401.

In other embodiment, the CAR molecule comprises a BCMA CAR molecule, or an antigen binding domain against BCMA described herein, e.g., a BCMA CAR described in US-2016-0046724-A1 or WO2016/014565. In embodiments, the BCMA CAR comprises an amino acid, or has a nucleotide sequence of a CAR molecule, or an antigen binding domain according to US-2016-0046724-A1, or Table 1 or 16, SEQ ID NO: 271 or SEQ ID NO: 273 of WO2016/014565, incorporated herein by reference, or a sequence substantially identical to any of the aforesaid sequences (e.g., at least 85%, 90%, 95% or more identical to any of the aforesaid BCMA CAR sequences). The amino acid and nucleotide sequences encoding the BCMA CAR molecules and antigen binding domains (e.g., including one, two, three VH CDRs; and one, two, three VL CDRs according to Kabat or Chothia), are specified in WO2016/014565.

In one embodiment, an antigen binding domain against GFR ALPHA-4 CAR antigen is an antigen binding portion, e.g., CDRs, of an antibody described in, e.g., WO2016/025880, incorporated herein by reference. In one embodiment, the CAR molecule comprises an a GFR ALPHA-4 CAR, e.g., a CAR molecule, or an antigen binding domain according to Table 2 of WO2016/025880, incorporated herein by reference, or a sequence substantially identical to any of the aforesaid sequences (e.g., at least 85%, 90%, 95% or more identical to any of the aforesaid GFR ALPHA-4 sequences). The amino acid and nucleotide sequences encoding the GFR ALPHA-4 CAR molecules and antigen binding domains (e.g., including one, two, three VH CDRs; and one, two, three VL CDRs according to Kabat or Chothia), are specified in WO2016/025880.

In one embodiment, an antigen binding domain against Tn antigen is an antigen binding portion, e.g., CDRs, of an antibody described in, e.g., U.S. Pat. No. 8,440,798; Brooks et al., PNAS 107(22):10056-10061 (2010), and Stone et al., OncoImmunology 1(6):863-873(2012).

In one embodiment, an antigen binding domain against PSMA is an antigen binding portion, e.g., CDRs, of an antibody described in, e.g., Parker et al., Protein Expr Purif 89(2):136-145 (2013), US 20110268656 (J591 ScFv); Frigerio et al, European J Cancer 49(9):2223-2232 (2013) (scFvD2B); WO 2006125481 (mAbs 3/A12, 3/E7 and 3/F11) and single chain antibody fragments (scFv A5 and D7).

In one embodiment, an antigen binding domain against ROR1 is an antigen binding portion, e.g., CDRs, of an antibody described in, e.g., Hudecek et al., Clin Cancer Res 19(12):3153-3164 (2013); WO 2011159847; and US20130101607.

In one embodiment, an antigen binding domain against FLT3 is an antigen binding portion, e.g., CDRs, of an antibody described in, e.g., WO2011076922, U.S. Pat. No. 5,777,084, EP0754230, US20090297529, and several commercial catalog antibodies (R&D, ebiosciences, Abcam).

In one embodiment, an antigen binding domain against TAG72 is an antigen binding portion, e.g., CDRs, of an antibody described in, e.g., Hombach et al., Gastroenterology 113(4):1163-1170 (1997); and Abcam ab691.

In one embodiment, an antigen binding domain against FAP is an antigen binding portion, e.g., CDRs, of an antibody described in, e.g., Ostermann et al., Clinical Cancer Research 14:4584-4592 (2008) (FAPS), US Pat. Publication No. 2009/0304718; sibrotuzumab (see e.g., Hofheinz et al., Oncology Research and Treatment 26(1), 2003); and Tran et al., J Exp Med 210(6):1125-1135 (2013).

In one embodiment, an antigen binding domain against CD38 is an antigen binding portion, e.g., CDRs, of daratumumab (see, e.g., Groen et al., Blood 116(21):1261-1262 (2010); MOR202 (see, e.g., U.S. Pat. No. 8,263,746); or antibodies described in U.S. Pat. No. 8,362,211.

In one embodiment, an antigen binding domain against CD44v6 is an antigen binding portion, e.g., CDRs, of an antibody described in, e.g., Casucci et al., Blood 122(20): 3461-3472 (2013).

In one embodiment, an antigen binding domain against CEA is an antigen binding portion, e.g., CDRs, of an antibody described in, e.g., Chmielewski et al., Gastoenterology 143(4):1095-1107 (2012).

In one embodiment, an antigen binding domain against EPCAM is an antigen binding portion, e.g., CDRS, of an antibody selected from MT110, EpCAM-CD3 bispecific Ab (see, e.g., clinicaltrials.gov/ct2/show/NCT00635596); Edrecolomab; 3622W94; ING-1; and adecatumumab (MT201).

In one embodiment, an antigen binding domain against PRSS21 is an antigen binding portion, e.g., CDRs, of an antibody described in U.S. Pat. No. 8,080,650.

In one embodiment, an antigen binding domain against B7H3 is an antigen binding portion, e.g., CDRs, of an antibody MGA271 (Macrogenics).

In one embodiment, an antigen binding domain against KIT is an antigen binding portion, e.g., CDRs, of an antibody described in, e.g., U.S. Pat. No. 7,915,391, US20120288506, and several commercial catalog antibodies.

In one embodiment, an antigen binding domain against IL-13Ra2 is an antigen binding portion, e.g., CDRs, of an antibody described in, e.g., WO2008/146911, WO2004087758, several commercial catalog antibodies, and WO2004087758.

In one embodiment, an antigen binding domain against CD30 is an antigen binding portion, e.g., CDRs, of an antibody described in, e.g., U.S. Pat. No. 7,090,843 B1, and EP0805871.

In one embodiment, an antigen binding domain against GD3 is an antigen binding portion, e.g., CDRs, of an antibody described in, e.g., U.S. Pat. No. 7,253,263; 8,207,308; US 20120276046; EP1013761; WO2005035577; and U.S. Pat. No. 6,437,098.

In one embodiment, an antigen binding domain against CD171 is an antigen binding portion, e.g., CDRs, of an antibody described in, e.g., Hong et al., J Immunother 37(2):93-104 (2014).

In one embodiment, an antigen binding domain against IL-11Ra is an antigen binding portion, e.g., CDRs, of an antibody available from Abcam (cat #ab55262) or Novus Biologicals (cat #EPR5446). In another embodiment, an antigen binding domain again IL-11Ra is a peptide, see, e.g., Huang et al., Cancer Res 72(1):271-281 (2012).

In one embodiment, an antigen binding domain against PSCA is an antigen binding portion, e.g., CDRs, of an antibody described in, e.g., Morgenroth et al., Prostate 67(10):1121-1131 (2007) (scFv 7F5); Nejatollahi et al., J of Oncology 2013(2013), article ID 839831 (scFv C5-II); and US Pat Publication No. 20090311181.

In one embodiment, an antigen binding domain against VEGFR2 is an antigen binding portion, e.g., CDRs, of an antibody described in, e.g., Chinnasamy et al., J Clin Invest 120(11):3953-3968 (2010).

In one embodiment, an antigen binding domain against LewisY is an antigen binding portion, e.g., CDRs, of an antibody described in, e.g., Kelly et al., Cancer Biother Radiopharm 23(4):411-423 (2008) (hu3S193 Ab (scFvs)); Dolezal et al., Protein Engineering 16(1):47-56 (2003) (NC10 scFv).

In one embodiment, an antigen binding domain against CD24 is an antigen binding portion, e.g., CDRs, of an antibody described in, e.g., Maliar et al., Gastroenterology 143(5):1375-1384 (2012).

In one embodiment, an antigen binding domain against PDGFR-beta is an antigen binding portion, e.g., CDRs, of an antibody Abcam ab32570.

In one embodiment, an antigen binding domain against SSEA-4 is an antigen binding portion, e.g., CDRs, of antibody MC813 (Cell Signaling), or other commercially available antibodies.

In one embodiment, an antigen binding domain against CD20 is an antigen binding portion, e.g., CDRs, of the antibody Rituximab, Ofatumumab, Ocrelizumab, Veltuzumab, or GA101.

In one embodiment, an antigen binding domain against Folate receptor alpha is an antigen binding portion, e.g., CDRs, of the antibody IMGN853, or an antibody described in US20120009181; U.S. Pat. No. 4,851,332, LK26: U.S. Pat. No. 5,952,484.

In one embodiment, an antigen binding domain against ERBB2 (Her2/neu) is an antigen binding portion, e.g., CDRs, of the antibody trastuzumab, or pertuzumab.

In one embodiment, an antigen binding domain against MUC1 is an antigen binding portion, e.g., CDRs, of the antibody SAR566658.

In one embodiment, the antigen binding domain against EGFR is antigen binding portion, e.g., CDRs, of the antibody cetuximab, panitumumab, zalutumumab, nimotuzumab, or matuzumab.

In one embodiment, an antigen binding domain against NCAM is an antigen binding portion, e.g., CDRs, of the antibody clone 2-2B: MAB5324 (EMD Millipore).

In one embodiment, an antigen binding domain against Ephrin B2 is an antigen binding portion, e.g., CDRs, of an antibody described in, e.g., Abengozar et al., Blood 119(19): 4565-4576 (2012).

In one embodiment, an antigen binding domain against IGF-I receptor is an antigen binding portion, e.g., CDRs, of an antibody described in, e.g., U.S. Pat. No. 8,344,112 B2; EP2322550 A1; WO 2006/138315, or PCT/US2006/022995.

In one embodiment, an antigen binding domain against CAIX is an antigen binding portion, e.g., CDRs, of the antibody clone 303123 (R&D Systems).

In one embodiment, an antigen binding domain against LMP2 is an antigen binding portion, e.g., CDRs, of an antibody described in, e.g., U.S. Pat. No. 7,410,640, or US20050129701.

In one embodiment, an antigen binding domain against gp100 is an antigen binding portion, e.g., CDRs, of the antibody HMB45, NKIbetaB, or an antibody described in WO2013165940, or US20130295007

In one embodiment, an antigen binding domain against tyrosinase is an antigen binding portion, e.g., CDRs, of an antibody described in, e.g., U.S. Pat. No. 5,843,674; or US19950504048.

In one embodiment, an antigen binding domain against EphA2 is an antigen binding portion, e.g., CDRs, of an antibody described in, e.g., Yu et al., Mol Ther 22(1):102-111 (2014).

In one embodiment, an antigen binding domain against GD3 is an antigen binding portion, e.g., CDRs, of an antibody described in, e.g., U.S. Pat. Nos. 7,253,263; 8,207,308; US 20120276046; EP1013761 A3; 20120276046; WO2005035577; or U.S. Pat. No. 6,437,098.

In one embodiment, an antigen binding domain against fucosyl GM1 is an antigen binding portion, e.g., CDRs, of an antibody described in, e.g., US20100297138; or WO2007/067992.

In one embodiment, an antigen binding domain against sLe is an antigen binding portion, e.g., CDRs, of the antibody G193 (for lewis Y), see Scott A M et al, Cancer Res 60: 3254-61 (2000), also as described in Neeson et al, J Immunol May 2013 190 (Meeting Abstract Supplement) 177.10.

In one embodiment, an antigen binding domain against GM3 is an antigen binding portion, e.g., CDRs, of the antibody CA 2523449 (mAb 14F7).

In one embodiment, an antigen binding domain against HMWMAA is an antigen binding portion, e.g., CDRs, of an antibody described in, e.g., Kmiecik et al., Oncoimmunology 3(1):e27185 (2014) (PMID: 24575382) (mAb9.2.27); U.S. Pat. No. 6,528,481; WO2010033866; or US 20140004124.

In one embodiment, an antigen binding domain against o-acetyl-GD2 is an antigen binding portion, e.g., CDRs, of the antibody 8B6.

In one embodiment, an antigen binding domain against TEM1/CD248 is an antigen binding portion, e.g., CDRs, of an antibody described in, e.g., Marty et al., Cancer Lett 235(2):298-308 (2006); Zhao et al., J Immunol Methods 363(2):221-232 (2011).

In one embodiment, an antigen binding domain against CLDN6 is an antigen binding portion, e.g., CDRs, of the antibody IMAB027 (Ganymed Pharmaceuticals), see e.g., clinicaltrial.gov/show/NCT02054351.

In one embodiment, an antigen binding domain against TSHR is an antigen binding portion, e.g., CDRs, of an antibody described in, e.g., U.S. Pat. Nos. 8,603,466; 8,501,415; or 8,309,693.

In one embodiment, an antigen binding domain against GPRC5D is an antigen binding portion, e.g., CDRs, of the antibody FAB6300A (R&D Systems); or LS-A4180 (Lifespan Biosciences).

In one embodiment, an antigen binding domain against CD97 is an antigen binding portion, e.g., CDRs, of an antibody described in, e.g., U.S. Pat. No. 6,846,911; de Groot et al., J Immunol 183(6):4127-4134 (2009); or an antibody from R&D:MAB3734.

In one embodiment, an antigen binding domain against ALK is an antigen binding portion, e.g., CDRs, of an antibody described in, e.g., Mino-Kenudson et al., Clin Cancer Res 16(5):1561-1571 (2010).

In one embodiment, an antigen binding domain against polysialic acid is an antigen binding portion, e.g., CDRs, of an antibody described in, e.g., Nagae et al., J Biol Chem 288(47):33784-33796 (2013).

In one embodiment, an antigen binding domain against PLAC1 is an antigen binding portion, e.g., CDRs, of an antibody described in, e.g., Ghods et al., Biotechnol Appl Biochem 2013 doi:10.1002/bab.1177.

In one embodiment, an antigen binding domain against GloboH is an antigen binding portion of the antibody VK9; or an antibody described in, e.g., Kudryashov V et al, Glycoconj J.15(3):243-9 (1998), Lou et al., Proc Natl Acad Sci USA 111(7):2482-2487 (2014); MBr1: Bremer E-G et al. J Biol Chem 259:14773-14777 (1984).

In one embodiment, an antigen binding domain against NY-BR-1 is an antigen binding portion, e.g., CDRs of an antibody described in, e.g., Jager et al., Appl Immunohistochem Mol Morphol 15(1):77-83 (2007).

In one embodiment, an antigen binding domain against WT-1 is an antigen binding portion, e.g., CDRs, of an antibody described in, e.g., Dao et al., Sci Transl Med 5(176):176ra33 (2013); or WO2012/135854.

In one embodiment, an antigen binding domain against MAGE-A1 is an antigen binding portion, e.g., CDRs, of an antibody described in, e.g., Willemsen et al., J Immunol 174(12):7853-7858 (2005) (TCR-like scFv).

In one embodiment, an antigen binding domain against sperm protein 17 is an antigen binding portion, e.g., CDRs, of an antibody described in, e.g., Song et al., Target Oncol 2013 Aug. 14 (PMID: 23943313); Song et al., Med Oncol 29(4):2923-2931 (2012).

In one embodiment, an antigen binding domain against Tie 2 is an antigen binding portion, e.g., CDRs, of the antibody AB33 (Cell Signaling Technology).

In one embodiment, an antigen binding domain against MAD-CT-2 is an antigen binding portion, e.g., CDRs, of an antibody described in, e.g., PMID: 2450952; U.S. Pat. No. 7,635,753.

In one embodiment, an antigen binding domain against Fos-related antigen 1 is an antigen binding portion, e.g., CDRs, of the antibody 12F9 (Novus Biologicals).

In one embodiment, an antigen binding domain against MelanA/MART1 is an antigen binding portion, e.g., CDRs, of an antibody described in, EP2514766 A2; or U.S. Pat. No. 7,749,719.

In one embodiment, an antigen binding domain against sarcoma translocation breakpoints is an antigen binding portion, e.g., CDRs, of an antibody described in, e.g., Luo et al, EMBO Mol. Med. 4(6):453-461 (2012).

In one embodiment, an antigen binding domain against TRP-2 is an antigen binding portion, e.g., CDRs, of an antibody described in, e.g., Wang et al, J Exp Med. 184(6): 2207-16 (1996).

In one embodiment, an antigen binding domain against CYP1B1 is an antigen binding portion, e.g., CDRs, of an antibody described in, e.g., Maecker et al, Blood 102 (9): 3287-3294 (2003).

In one embodiment, an antigen binding domain against RAGE-1 is an antigen binding portion, e.g., CDRs, of the antibody MAB5328 (EMD Millipore).

In one embodiment, an antigen binding domain against human telomerase reverse transcriptase is an antigen binding portion, e.g., CDRs, of the antibody cat no: LS-B95-100 (Lifespan Biosciences)

In one embodiment, an antigen binding domain against intestinal carboxyl esterase is an antigen binding portion, e.g., CDRs, of the antibody 4F12: cat no: LS-B6190-50 (Lifespan Biosciences).

In one embodiment, an antigen binding domain against mut hsp70-2 is an antigen binding portion, e.g., CDRs, of the antibody Lifespan Biosciences: monoclonal: cat no: LS-C133261-100 (Lifespan Biosciences).

In one embodiment, an antigen binding domain against CD79a is an antigen binding portion, e.g., CDRs, of the antibody Anti-CD79a antibody [HM47/A9] (ab3121), available from Abcam; antibody CD79A Antibody #3351 available from Cell Signalling Technology; or antibody HPA017748—Anti-CD79A antibody produced in rabbit, available from Sigma Aldrich.

In one embodiment, an antigen binding domain against CD79b is an antigen binding portion, e.g., CDRs, of the antibody polatuzumab vedotin, anti-CD79b described in Dornan et al., "Therapeutic potential of an anti-CD79b antibody-drug conjugate, anti-CD79b-vc-MMAE, for the treatment of non-Hodgkin lymphoma" Blood. 2009 Sep. 24; 114(13):2721-9. doi: 10.1182/blood-2009-02-205500. Epub 2009 Jul. 24, or the bispecific antibody Anti-CD79b/CD3 described in "4507 Pre-Clinical Characterization of T Cell-Dependent Bispecific Antibody Anti-CD79b/CD3 As a Potential Therapy for B Cell Malignancies" Abstracts of 56$^{th}$ ASH Annual Meeting and Exposition, San Francisco, Calif. Dec. 6-9 2014.

In one embodiment, an antigen binding domain against CD72 is an antigen binding portion, e.g., CDRs, of the antibody J3-109 described in Myers, and Uckun, "An anti-CD72 immunotoxin against therapy-refractory B-lineage acute lymphoblastic leukemia." Leuk Lymphoma. 1995 June; 18(1-2):119-22, or anti-CD72 (10D6.8.1, mIgG1) described in Polson et al., "Antibody-Drug Conjugates for the Treatment of Non-Hodgkin's Lymphoma: Target and Linker-Drug Selection" Cancer Res Mar. 15, 2009 69; 2358.

In one embodiment, an antigen binding domain against LAIR1 is an antigen binding portion, e.g., CDRs, of the antibody ANT-301 LAIR1 antibody, available from ProSpec; or anti-human CD305 (LAIR1) Antibody, available from BioLegend.

In one embodiment, an antigen binding domain against FCAR is an antigen binding portion, e.g., CDRs, of the antibody CD89/FCARAntibody (Catalog #10414-H08H), available from Sino Biological Inc.

In one embodiment, an antigen binding domain against LILRA2 is an antigen binding portion, e.g., CDRs, of the antibody LILRA2 monoclonal antibody (M17), clone 3C7, available from Abnova, or Mouse Anti-LILRA2 antibody, Monoclonal (2D7), available from Lifespan Biosciences.

In one embodiment, an antigen binding domain against CD300LF is an antigen binding portion, e.g., CDRs, of the antibody Mouse Anti-CMRF35-like molecule 1 antibody, Monoclonal[UP-D2], available from BioLegend, or Rat Anti-CMRF35-like molecule 1 antibody, Monoclonal [234903], available from R&D Systems.

In one embodiment, an antigen binding domain against CLEC12A is an antigen binding portion, e.g., CDRs, of the antibody Bispecific T cell Engager (BiTE) scFv-antibody and ADC described in Noordhuis et al., "Targeting of CLEC12A In Acute Myeloid Leukemia by Antibody-Drug-Conjugates and Bispecific CLL-1×CD3 BiTE Antibody" 53$^{rd}$ ASH Annual Meeting and Exposition, Dec. 10-13, 2011, and MCLA-117 (Merus).

In one embodiment, an antigen binding domain against BST2 (also called CD317) is an antigen binding portion, e.g., CDRs, of the antibody Mouse Anti-CD317 antibody, Monoclonal[3H4], available from Antibodies-Online or Mouse Anti-CD317 antibody, Monoclonal[696739], available from R&D Systems.

In one embodiment, an antigen binding domain against EMR2 (also called CD312) is an antigen binding portion, e.g., CDRs, of the antibody Mouse Anti-CD312 antibody, Monoclonal[LS-B8033] available from Lifespan Biosciences, or Mouse Anti-CD312 antibody, Monoclonal [494025] available from R&D Systems.

In one embodiment, an antigen binding domain against LY75 is an antigen binding portion, e.g., CDRs, of the antibody Mouse Anti-Lymphocyte antigen 75 antibody, Monoclonal[HD30] available from EMD Millipore or Mouse Anti-Lymphocyte antigen 75 antibody, Monoclonal [A15797] available from Life Technologies.

In one embodiment, an antigen binding domain against GPC3 is an antigen binding portion, e.g., CDRs, of the antibody hGC33 described in Nakano K, Ishiguro T, Konishi H, et al. Generation of a humanized anti-glypican 3 antibody by CDR grafting and stability optimization. Anticancer Drugs. 2010 November; 21(10):907-916, or MDX-1414, HN3, or YP7, all three of which are described in Feng et al., "Glypican-3 antibodies: a new therapeutic target for liver cancer." FEBS Lett. 2014 Jan. 21; 588(2):377-82.

In one embodiment, an antigen binding domain against FCRLS is an antigen binding portion, e.g., CDRs, of the anti-FcRL5 antibody described in Elkins et al., "FcRL5 as a target of antibody-drug conjugates for the treatment of multiple myeloma" Mol Cancer Ther. 2012 October; 11(10): 2222-32.

In one embodiment, an antigen binding domain against IGLL1 is an antigen binding portion, e.g., CDRs, of the antibody Mouse Anti-Immunoglobulin lambda-like polypeptide 1 antibody, Monoclonal[AT1G4] available from Lifespan Biosciences, Mouse Anti-Immunoglobulin lambda-like polypeptide 1 antibody, Monoclonal[HSL11] available from BioLegend.

In one embodiment, the antigen binding domain comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed above.

In another aspect, the antigen binding domain comprises a humanized antibody or an antibody fragment. In some aspects, a non-human antibody is humanized, where specific sequences or regions of the antibody are modified to increase similarity to an antibody naturally produced in a human or fragment thereof. In one aspect, the antigen binding domain is humanized.

Bispecific CARS

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope.

In certain embodiments, the antibody molecule is a multispecific (e.g., a bispecific or a trispecific) antibody molecule. Protocols for generating bispecific or heterodimeric antibody molecules are known in the art; including but not limited to, for example, the "knob in a hole" approach described in, e.g., U.S. Pat. No. 5,731,168; the electrostatic steering Fc pairing as described in, e.g., WO 09/089004, WO 06/106905 and WO 2010/129304; Strand Exchange Engineered Domains (SEED) heterodimer formation as described in, e.g., WO 07/110205; Fab arm exchange as described in, e.g., WO 08/119353, WO 2011/131746, and WO 2013/060867; double antibody conjugate, e.g., by antibody cross-linking to generate a bi-specific structure using a heterobifunctional reagent having an amine-reactive group and a sulfhydryl reactive group as described in, e.g., U.S. Pat. No. 4,433,059; bispecific antibody determinants generated by recombining half antibodies (heavy-light chain pairs or Fabs) from different antibodies through cycle of reduction and oxidation of disulfide bonds between the two heavy chains, as described in, e.g., U.S. Pat. No. 4,444,878; trifunctional antibodies, e.g., three Fab' fragments cross-linked through sulfhdryl reactive groups, as described in, e.g., U.S. Pat. No. 5,273,743; biosynthetic binding proteins, e.g., pair of scFvs cross-linked through C-terminal tails preferably through disulfide or amine-reactive chemical cross-linking, as described in, e.g., U.S. Pat. No. 5,534,254; bifunctional antibodies, e.g., Fab fragments with different binding specificities dimerized through leucine zippers (e.g., c-fos and c-jun) that have replaced the constant domain, as described in, e.g., U.S. Pat. No. 5,582,996; bispecific and oligospecific mono- and oligovalent receptors, e.g., VH-CH1 regions of two antibodies (two Fab fragments) linked through a polypeptide spacer between the CH1 region of one antibody and the VH region of the other antibody typically with associated light chains, as described in, e.g., U.S. Pat. No. 5,591,828; bispecific DNA-antibody conjugates, e.g., crosslinking of antibodies or Fab fragments through a double stranded piece of DNA, as described in, e.g., U.S. Pat. No. 5,635,602; bispecific fusion proteins, e.g., an expression construct containing two scFvs with a hydrophilic helical peptide linker between them and a full constant region, as described in, e.g., U.S. Pat. No. 5,637,481; multivalent and multispecific binding proteins, e.g., dimer of polypeptides having first domain with binding region of Ig heavy chain variable region, and second domain with binding region of Ig light chain variable region, generally termed diabodies (higher order structures are also encompassed creating for bispecifc, trispecific, or tetraspecific molecules, as described in, e.g., U.S. Pat. No. 5,837,242; minibody constructs with linked VL and VH chains further connected with peptide spacers to an antibody hinge region and CH3 region, which can be dimerized to form bispecific/multivalent molecules, as described in, e.g., U.S. Pat. No. 5,837,821; VH and VL domains linked with a short peptide linker (e.g., 5 or 10 amino acids) or no linker at all in either orientation, which can form dimers to form bispecific diabodies; trimers and tetramers, as described in, e.g., U.S. Pat. No. 5,844,094; String of VH domains (or VL domains in family members) connected by peptide linkages with cross-linkable groups at the C-terminus further associated with VL domains to form a series of FVs (or scFvs), as described in, e.g., U.S. Pat. No. 5,864,019; and single chain binding polypeptides with both a VH and a VL domain linked through a peptide linker are combined into multivalent structures through non-covalent or chemical crosslinking to form, e.g., homobivalent, heterobivalent, trivalent, and tetravalent structures using both scFV or diabody type format, as described in, e.g., U.S. Pat. No. 5,869,620. Additional exemplary multispecific and bispecific molecules and methods of making the same are found, for example, in U.S. Pat. Nos. 5,910,573, 5,932,448, 5,959,083, 5,989,830, 6,005,079, 6,239,259, 6,294,353, 6,333,396, 6,476,198, 6,511,663, 6,670,453, 6,743,896, 6,809,185, 6,833,441, 7,129,330, 7,183,076, 7,521,056, 7,527,787, 7,534,866, 7,612,181, US2002004587A1, US2002076406A1, US2002103345A1, US2003207346A1, US2003211078A1, US2004219643A1, US2004220388A1, US2004242847A1, US2005003403A1, US2005004352A1, US2005069552A1, US2005079170A1, US2005100543A1, US2005136049A1, US2005136051A1, US2005163782A1, US2005266425A1, US2006083747A1, US2006120960A1, US2006204493A1, US2006263367A1, US2007004909A1, US2007087381A1, US2007128150A1, US2007141049A1, US2007154901A1, US2007274985A1, US2008050370A1, US2008069820A1, US2008152645A1, US2008171855A1, US2008241884A1, US2008254512A1, US2008260738A1, US2009130106A1, US2009148905A1, US2009155275A1, US2009162359A1, US2009162360A1, US2009175851A1, US2009175867A1, US2009232811A1, US2009234105A1, US2009263392A1, US2009274649A1, EP346087A2, WO0006605A2, WO02072635A2, WO04081051A1, WO06020258A2, WO2007044887A2, WO2007095338A2, WO2007137760A2, WO2008119353A1, WO2009021754A2, WO2009068630A1, WO9103493A1, WO9323537A1, WO9409131A1, WO9412625A2, WO9509917A1, WO9637621A2, WO9964460A1. The contents of the above-referenced applications are incorporated herein by reference in their entireties.

Within each antibody or antibody fragment (e.g., scFv) of a bispecific antibody molecule, the VH can be upstream or downstream of the VL. In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$. In other embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-$VL_2$. Optionally, a linker is disposed between the two antibodies or antibody fragments (e.g., scFvs), e.g., between $VL_1$ and $VL_2$ if the construct is arranged as $VH_1$-$VL_1$-$VL_2$-$VH_2$, or between $VH_1$ and $VH_2$ if the construct is arranged as $VL_1$-$VH_1$-$VH_2$-$VL_2$. The linker may be a linker as described herein, e.g., a $(Gly_4$-Ser)n linker, wherein n is 1, 2, 3, 4, 5, or 6, preferably 4 (SEQ ID NO: 78). In general, the linker between the two scFvs should be long enough to avoid mispairing between the domains of the two scFvs. Optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

Stability and Mutations

The stability of an antigen binding domain to a cancer associated antigen as described herein, e.g., scFv molecules (e.g., soluble scFv), can be evaluated in reference to the biophysical properties (e.g., thermal stability) of a conventional control scFv molecule or a full length antibody. In one embodiment, the humanized scFv has a thermal stability that is greater than about 0.1, about 0.25, about 0.5, about 0.75, about 1, about 1.25, about 1.5, about 1.75, about 2, about 2.5, about 3, about 3.5, about 4, about 4.5, about 5, about 5.5, about 6, about 6.5, about 7, about 7.5, about 8, about 8.5, about 9, about 9.5, about 10 degrees, about 11 degrees, about 12 degrees, about 13 degrees, about 14 degrees, or about 15 degrees Celsius than a control binding molecule (e.g. a conventional scFv molecule) in the described assays.

The improved thermal stability of the antigen binding domain to a cancer associated antigen described herein, e.g., scFv is subsequently conferred to the entire CAR construct, leading to improved therapeutic properties of the CAR construct. The thermal stability of the antigen binding domain of —a cancer associated antigen described herein, e.g., scFv, can be improved by at least about 2° C. or 3° C.

as compared to a conventional antibody. In one embodiment, the antigen binding domain of—a cancer associated antigen described herein, e.g., scFv, has a 1° C. improved thermal stability as compared to a conventional antibody. In another embodiment, the antigen binding domain of a cancer associated antigen described herein, e.g., scFv, has a 2° C. improved thermal stability as compared to a conventional antibody. In another embodiment, the scFv has a 4, 5, 6, 7, 8, 9, 10, 11, 12, 13, 14, 15° C. improved thermal stability as compared to a conventional antibody. Comparisons can be made, for example, between the scFv molecules disclosed herein and scFv molecules or Fab fragments of an antibody from which the scFv VH and VL were derived. Thermal stability can be measured using methods known in the art. For example, in one embodiment, Tm can be measured. Methods for measuring Tm and other methods of determining protein stability are described in more detail below.

Mutations in scFv (arising through humanization or direct mutagenesis of the soluble scFv) can alter the stability of the scFv and improve the overall stability of the scFv and the CAR construct. Stability of the humanized scFv is compared against the murine scFv using measurements such as Tm, temperature denaturation and temperature aggregation.

The binding capacity of the mutant scFvs can be determined using assays know in the art and described herein.

In one embodiment, the antigen binding domain of a cancer associated antigen described herein, e.g., scFv, comprises at least one mutation arising from the humanization process such that the mutated scFv confers improved stability to the CAR construct. In another embodiment, the antigen binding domain of —a cancer associated antigen described herein, e.g., scFv, comprises at least 1, 2, 3, 4, 5, 6, 7, 8, 9, 10 mutations arising from the humanization process such that the mutated scFv confers improved stability to the CAR construct.

Methods of Evaluating Protein Stability

The stability of an antigen binding domain may be assessed using, e.g., the methods described below. Such methods allow for the determination of multiple thermal unfolding transitions where the least stable domain either unfolds first or limits the overall stability threshold of a multidomain unit that unfolds cooperatively (e.g., a multidomain protein which exhibits a single unfolding transition). The least stable domain can be identified in a number of additional ways. Mutagenesis can be performed to probe which domain limits the overall stability. Additionally, protease resistance of a multidomain protein can be performed under conditions where the least stable domain is known to be intrinsically unfolded via DSC or other spectroscopic methods (Fontana, et al., (1997) Fold. Des., 2: R17-26; Dimasi et al. (2009) J. Mol. Biol. 393: 672-692). Once the least stable domain is identified, the sequence encoding this domain (or a portion thereof) may be employed as a test sequence in the methods.

Thermal Stability

The thermal stability of the compositions may be analyzed using a number of non-limiting biophysical or biochemical techniques known in the art. In certain embodiments, thermal stability is evaluated by analytical spectroscopy.

An exemplary analytical spectroscopy method is Differential Scanning Calorimetry (DSC). DSC employs a calorimeter which is sensitive to the heat absorbances that accompany the unfolding of most proteins or protein domains (see, e.g. Sanchez-Ruiz, et al., Biochemistry, 27: 1648-52, 1988). To determine the thermal stability of a protein, a sample of the protein is inserted into the calorimeter and the temperature is raised until the Fab or scFv unfolds. The temperature at which the protein unfolds is indicative of overall protein stability.

Another exemplary analytical spectroscopy method is Circular Dichroism (CD) spectroscopy. CD spectrometry measures the optical activity of a composition as a function of increasing temperature. Circular dichroism (CD) spectroscopy measures differences in the absorption of left-handed polarized light versus right-handed polarized light which arise due to structural asymmetry. A disordered or unfolded structure results in a CD spectrum very different from that of an ordered or folded structure. The CD spectrum reflects the sensitivity of the proteins to the denaturing effects of increasing temperature and is therefore indicative of a protein's thermal stability (see van Mierlo and Steemsma, J. Biotechnol., 79(3):281-98, 2000).

Another exemplary analytical spectroscopy method for measuring thermal stability is Fluorescence Emission Spectroscopy (see van Mierlo and Steemsma, supra). Yet another exemplary analytical spectroscopy method for measuring thermal stability is Nuclear Magnetic Resonance (NMR) spectroscopy (see, e.g. van Mierlo and Steemsma, supra). The thermal stability of a composition can be measured biochemically. An exemplary biochemical method for assessing thermal stability is a thermal challenge assay. In a "thermal challenge assay", a composition is subjected to a range of elevated temperatures for a set period of time. For example, in one embodiment, test scFv molecules or molecules comprising scFv molecules are subject to a range of increasing temperatures, e.g., for 1-1.5 hours. The activity of the protein is then assayed by a relevant biochemical assay. For example, if the protein is a binding protein (e.g. an scFv or scFv-containing polypeptide) the binding activity of the binding protein may be determined by a functional or quantitative ELISA.

Such an assay may be done in a high-throughput format and those disclosed in the Examples using E. coli and high throughput screening. A library of antigen binding domains, e.g., that includes an antigen binding domain to—a cancer associated antigen described herein, e.g., scFv variants, may be created using methods known in the art. Antigen binding domain, e.g., to—a cancer associated antigen described herein, e.g., scFv, expression may be induced and the antigen binding domain, e.g., to—a cancer associated antigen described herein, e.g., scFv, may be subjected to thermal challenge. The challenged test samples may be assayed for binding and those antigen binding domains to—a cancer associated antigen described herein, e.g., scFvs, which are stable may be scaled up and further characterized.

Thermal stability is evaluated by measuring the melting temperature (Tm) of a composition using any of the above techniques (e.g. analytical spectroscopy techniques). The melting temperature is the temperature at the midpoint of a thermal transition curve wherein 50% of molecules of a composition are in a folded state (See e.g., Dimasi et al. (2009) J. Mol Biol. 393: 672-692). In one embodiment, Tm values for an antigen binding domain to—a cancer associated antigen described herein, e.g., scFv, are about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an IgG is about 40° C., 41° C., 42° C., 43° C., 44°

C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C. In one embodiment, Tm values for an multivalent antibody is about 40° C., 41° C., 42° C., 43° C., 44° C., 45° C., 46° C., 47° C., 48° C., 49° C., 50° C., 51° C., 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., 72° C., 73° C., 74° C., 75° C., 76° C., 77° C., 78° C., 79° C., 80° C., 81° C., 82° C., 83° C., 84° C., 85° C., 86° C., 87° C., 88° C., 89° C., 90° C., 91° C., 92° C., 93° C., 94° C., 95° C., 96° C., 97° C., 98° C., 99° C., 100° C.

Thermal stability is also evaluated by measuring the specific heat or heat capacity (Cp) of a composition using an analytical calorimetric technique (e.g. DSC). The specific heat of a composition is the energy (e.g. in kcal/mol) is required to rise by 1° C., the temperature of 1 mol of water. As large Cp is a hallmark of a denatured or inactive protein composition. The change in heat capacity (ΔCp) of a composition is measured by determining the specific heat of a composition before and after its thermal transition. Thermal stability may also be evaluated by measuring or determining other parameters of thermodynamic stability including Gibbs free energy of unfolding (ΔG), enthalpy of unfolding (ΔH), or entropy of unfolding (ΔS). One or more of the above biochemical assays (e.g. a thermal challenge assay) are used to determine the temperature (i.e. the $T_C$ value) at which 50% of the composition retains its activity (e.g. binding activity).

In addition, mutations to the antigen binding domain of a cancer associated antigen described herein, e.g., scFv, can be made to alter the thermal stability of the antigen binding domain of a cancer associated antigen described herein, e.g., scFv, as compared with the unmutated antigen binding domain of a cancer associated antigen described herein, e.g., scFv. When the humanized antigen binding domain of a cancer associated antigen described herein, e.g., scFv, is incorporated into a CAR construct, the antigen binding domain of the cancer associated antigen described herein, e.g., humanized scFv, confers thermal stability to the overall CARs of the present invention. In one embodiment, the antigen binding domain to a cancer associated antigen described herein, e.g., scFv, comprises a single mutation that confers thermal stability to the antigen binding domain of the cancer associated antigen described herein, e.g., scFv. In another embodiment, the antigen binding domain to a cancer associated antigen described herein, e.g., scFv, comprises multiple mutations that confer thermal stability to the antigen binding domain to the cancer associated antigen described herein, e.g., scFv. In one embodiment, the multiple mutations in the antigen binding domain to a cancer associated antigen described herein, e.g., scFv, have an additive effect on thermal stability of the antigen binding domain to the cancer associated antigen described herein binding domain, e.g., scFv.

b) % Aggregation

The stability of a composition can be determined by measuring its propensity to aggregate. Aggregation can be measured by a number of non-limiting biochemical or biophysical techniques. For example, the aggregation of a composition may be evaluated using chromatography, e.g., Size-Exclusion Chromatography (SEC). SEC separates molecules on the basis of size. A column is filled with semi-solid beads of a polymeric gel that will admit ions and small molecules into their interior but not large ones. When a protein composition is applied to the top of the column, the compact folded proteins (i.e. non-aggregated proteins) are distributed through a larger volume of solvent than is available to the large protein aggregates. Consequently, the large aggregates move more rapidly through the column, and in this way the mixture can be separated or fractionated into its components. Each fraction can be separately quantified (e.g. by light scattering) as it elutes from the gel. Accordingly, the % aggregation of a composition can be determined by comparing the concentration of a fraction with the total concentration of protein applied to the gel. Stable compositions elute from the column as essentially a single fraction and appear as essentially a single peak in the elution profile or chromatogram.

c) Binding Affinity

The stability of a composition can be assessed by determining its target binding affinity. A wide variety of methods for determining binding affinity are known in the art. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jonsson, U., et al. (1993) Ann. Biol. Clin. 51:19-26; Jonsson, U., i (1991) Biotechniques 11:620-627; Johnsson, B., et al. (1995) J. Mol. Recognit. 8:125-131; and Johnnson, B., et al. (1991) Anal. Biochem. 198:268-277.

In one aspect, the antigen binding domain of the CAR comprises an amino acid sequence that is homologous to an antigen binding domain amino acid sequence described herein, and the antigen binding domain retains the desired functional properties of the antigen binding domain described herein.

In one specific aspect, the CAR composition of the invention comprises an antibody fragment. In a further aspect, the antibody fragment comprises an scFv.

In various aspects, the antigen binding domain of the CAR is engineered by modifying one or more amino acids within one or both variable regions (e.g., VH and/or VL), for example within one or more CDR regions and/or within one or more framework regions. In one specific aspect, the CAR composition of the invention comprises an antibody fragment. In a further aspect, the antibody fragment comprises an scFv.

It will be understood by one of ordinary skill in the art that the antibody or antibody fragment of the invention may further be modified such that they vary in amino acid sequence (e.g., from wild-type), but not in desired activity. For example, additional nucleotide substitutions leading to amino acid substitutions at "non-essential" amino acid residues may be made to the protein For example, a nonessential amino acid residue in a molecule may be replaced with another amino acid residue from the same side chain family. In another embodiment, a string of amino acids can be replaced with a structurally similar string that differs in order and/or composition of side chain family members, e.g., a conservative substitution, in which an amino acid residue is replaced with an amino acid residue having a similar side chain, may be made.

Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Percent identity in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

In one aspect, the present invention contemplates modifications of the starting antibody or fragment (e.g., scFv) amino acid sequence that generate functionally equivalent molecules. For example, the VH or VL of an antigen binding domain to—a cancer associated antigen described herein, e.g., scFv, comprised in the CAR can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting VH or VL framework region of the antigen binding domain to the cancer associated antigen described herein, e.g., scFv. The present invention contemplates modifications of the entire CAR construct, e.g., modifications in one or more amino acid sequences of the various domains of the CAR construct in order to generate functionally equivalent molecules. The CAR construct can be modified to retain at least about 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity of the starting CAR construct.

Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR e.g., in one embodiment, the transmembrane domain may be from the same protein that the signaling domain, costimulatory domain or the hinge domain is derived from. In another aspect, the transmembrane domain is not derived from the same protein that any other domain of the CAR is derived from. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CAR-expressing cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C, or a functional variant thereof.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge (e.g., an IgG4 hinge, an IgD hinge), a GS linker (e.g., a GS linker described herein), a KIR2DS2 hinge or a CD8a hinge. In one embodiment, the hinge or spacer comprises (e.g., consists of) the amino acid sequence of SEQ ID NO:403. In one aspect, the transmembrane domain comprises (e.g., consists of) a transmembrane domain of SEQ ID NO: 12.

In one aspect, the hinge or spacer comprises an IgG4 hinge. For example, in one embodiment, the hinge or spacer comprises a hinge of the amino acid sequence ESKYGPPCPPCPAPEFLGGPSVFLFPPKPKDTLMISRTPEVTCVVVDVSQEDPEVQFN WYVDGVEVHNAKTKPREEQFNSTYRVVSVLTVLHQDWLNGKEYKCKVSNKGLPS SIEKTISKAKGQPREPQVYTLPPSQEEMTKNQVSLTCLVKGFYPSDIAVEWESNGQP ENNYKTTPPVLDSDGSFFLYSRLTVDKSRWQEGNVFSCSVMHEALHNHYTQKSLS LSLGKM (SEQ ID NO:405). In some embodiments, the hinge or spacer comprises a hinge encoded by a nucleotide sequence of (SEQ ID NO: 406)
GAGAGCAAGTACGGCCCTCCCTGCCCCCCTTGCCCTGCCCCCGAGTTCCT

GGGCGGACCCAGCGTGTTCCTGTTCCCCCCCAAGCCCAAGGACACCCTGA

TGATCAGCCGGACCCCCGAGGTGACCTGTGTGGTGGTGGACGTGTCCCAG

GAGGACCCCGAGGTCCAGTTCAACTGGTACGTGGACGGCGTGGAGGTGCA

CAACGCCAAGACCAAGCCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG

GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG.

In one aspect, the hinge or spacer comprises an IgD hinge. For example, in one embodiment, the hinge or spacer comprises a hinge of the amino acid sequence RWPESPKAQASSVPTAQPQAEGSLAKATTAPATTRNTGRGGEEKKKEKEKEEQEE RETKTPECPSHTQPLGVYLLTPAVQDLWLRDKATFTCFVVGSDLKDAHLTWEVAG KVPTGGVEEGLLERHSNGSQSQHSRLTLPRSLWNAGTSVTCTLNHPSLPPQRLMAL REPAAQAPVKLSLNLLASSDPPEAASWLLCEVSGFSPPNILLMWLEDQREVNTSGF APARPPPQPGSTTFWAWSVLRVPAPPSPQPATYTCVVSHEDSRTLLNASRSLEVSYV TDH (SEQ ID NO:407). In some embodiments, the hinge or spacer comprises a hinge encoded by a nucleotide sequence of (SEQ ID NO: 408)
AGGTGGCCCGAAAGTCCCAAGGCCCAGGCATCTAGTGTTCCTACTGCACA

GCCCCAGGCAGAAGGCAGCCTAGCCAAAGCTACTACTGCACCTGCCACTA

CGCGCAATACTGGCCGTGGCGGGGAGGAGAAGAAAAAGGAGAAAGAGAAA

GAAGAACAGGAAGAGAGGGAGACCAAGACCCCTGAATGTCCATCCCATAC

CCAGCCGCTGGGCGTCTATCTCTTGACTCCCGCAGTACAGGACTTGTGGC

TTAGAGATAAGGCCACCTTTACATGTTTCGTCGTGGGCTCTGACCTGAAG

GATGCCCATTTGACTTGGGAGGTTGCCGGAAAGGTACCCACAGGGGGGGT

TGAGGAAGGGTTGCTGGAGCGCCATTCCAATGGCTCTCAGAGCCAGCACT

CAAGACTCACCCTTCCGAGATCCCTGTGGAACGCCGGGACCTCTGTCACA

TGTACTCTAAATCATCCTAGCCTGCCCCCACAGCGTCTGATGGCCCTTAG

AGAGCCAGCCGCCCAGGCACCAGTTAAGCTTAGCCTGAATCTGCTCGCCA

GTAGTGATCCCCCAGAGGCCGCCAGCTGGCTCTTATGCGAAGTGTCCGGC

TTTAGCCCGCCCAACATCTTGCTCATGTGGCTGGAGGACCAGCGAGAAGT

GAACACCAGCGGCTTCGCTCCAGCCCGGCCCCCACCCCAGCCGGGTTCTA

CCACATTCTGGGCCTGGAGTGTCTTAAGGGTCCCAGCACCACCTAGCCCC

CAGCCAGCCACATACACCTGTGTTGTGTCCCATGAAGATAGCAGGACCCT

GCTAAATGCTTCTAGGAGTCTGGAGGTTTCCTACGTGACTGACCATT.

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS
(SEQ ID NO:10). In some embodiments, the linker is encoded by a nucleotide sequence of (SEQ ID NO: 11)
GGTGGCGGAGGTTCTGGAGGTGGAGGTTCC.

In one aspect, the hinge or spacer comprises a KIR2DS2 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced. The term "effector function" refers to a specialized function of a cell. Effector function of a T cell, for example, may be cytolytic activity or helper activity including the secretion of cytokines. Thus the term "intracellular signaling domain" refers to the portion of a protein which transduces the effector function signal and directs the cell to perform a specialized function. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12, or a functional variant thereof. In one embodiment, a CAR of the invention comprises an intracellular signaling domain, e.g., a primary signaling domain of CD3-zeta, or a functional variant thereof. In one embodiment, a CAR of the invention comprises a primary signaling domain of CD3-zeta.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

The intracellular signalling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include CD5, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), NKG2D, CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, and CD19a, or a functional variant thereof.

The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta, the signalling domain of CD28, and the signaling domain of 4-1BB, or a functional variant thereof. In one aspect, the signaling domain of 4-1BB is a signaling domain of SEQ ID NO: 14. In one aspect, the signaling domain of CD3-zeta is a signaling domain of SEQ ID NO: 18. In one aspect, the signaling domain of CD28 is selected from SEQ ID NOs: 1-4, as described herein.

In one aspect, the intracellular signaling domain is designed to comprise the signaling domain of CD3-zeta, the signaling domain of CD28, and the signaling domain of CD27. In one aspect, the signaling domain of CD27 comprises the amino acid sequence of QRRKYRSNKGESPVE-PAEPCRYSCPREEEGSTIPIQEDYRKPEPACSP (SEQ ID NO:16). In one aspect, the signalling domain of CD27 is encoded by a nucleic acid sequence of (SEQ ID NO: 17)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC.

In one aspect, the CAR-expressing cell described herein can further comprise a second CAR, e.g., a second CAR that includes a different antigen binding domain, e.g., to the same target or a different target (e.g., a target other than a cancer associated antigen described herein or a different cancer associated antigen described herein). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In one embodiment, the CAR-expressing cell comprises an XCAR described herein and an inhibitory CAR. In one embodiment, the inhibitory CAR comprises an antigen binding domain that binds an antigen found on normal cells but not cancer cells, e.g., normal cells that also express CLL. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta.

In one embodiment, when the CAR-expressing cell comprises two or more different CARs, the antigen binding domains of the different CARs can be such that the antigen binding domains do not interact with one another. For example, a cell expressing a first and second CAR can have an antigen binding domain of the first CAR, e.g., as a fragment, e.g., an scFv, that does not form an association with the antigen binding domain of the second CAR, e.g., the antigen binding domain of the second CAR is a VHH.

In some embodiments, the antigen binding domain comprises a single domain antigen binding (SDAB) molecules include molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies. SDAB molecules may be any of the art, or any future single domain molecules. SDAB molecules may be derived from any species including, but not limited to mouse, human, camel, llama, lamprey, fish, shark, goat, rabbit, and bovine. This term also includes naturally occurring single domain antibody molecules from species other than Camelidae and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) Protein Sci. 14:2901-2909.

According to another aspect, an SDAB molecule is a naturally occurring single domain antigen binding molecule known as heavy chain devoid of light chains. Such single domain molecules are disclosed in WO 9404678 and Hamers-Casterman, C. et al. (1993) Nature 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from Camelidae species, for example in camel, llama, dromedary, alpaca and guanaco. Other species besides Camelidae may produce heavy chain molecules naturally devoid of light chain; such VHHs are within the scope of the invention.

The SDAB molecules can be recombinant, CDR-grafted, humanized, camelized, de-immunized and/or in vitro generated (e.g., selected by phage display).

It has also been discovered, that cells having a plurality of chimeric membrane embedded receptors comprising an antigen binding domain that interactions between the antigen binding domain of the receptors can be undesirable, e.g., because it inhibits the ability of one or more of the antigen binding domains to bind its cognate antigen. Accordingly, disclosed herein are cells having a first and a second non-naturally occurring chimeric membrane embedded receptor comprising antigen binding domains that minimize such interactions. Also disclosed herein are nucleic acids encoding a first and a second non-naturally occurring chimeric membrane embedded receptor comprising antigen binding domains that minimize such interactions, as well as methods of making and using such cells and nucleic acids. In an embodiment the antigen binding domain of one of said first said second non-naturally occurring chimeric membrane embedded receptor, comprises an scFv, and the other comprises a single VH domain, e.g., a camelid, shark, or lamprey single VH domain, or a single VH domain derived from a human or mouse sequence.

In some embodiments, the claimed invention comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

In some embodiments, the antigen binding domain of one of said first CAR said second CAR comprises an scFv, and the other comprises a single VH domain, e.g., a camelid, shark, or lamprey single VH domain, or a single VH domain derived from a human or mouse sequence. In some embodiments, the antigen binding domain of one of said first CAR said second CAR comprises an scFv, and the other comprises a nanobody. In some embodiments, the antigen binding domain of one of said first CAR said second CAR comprises an scFv, and the other comprises a camelid VHH domain.

In some embodiments, when present on the surface of a cell, binding of the antigen binding domain of said first CAR to its cognate antigen is not substantially reduced by the presence of said second CAR. In some embodiments, binding of the antigen binding domain of said first CAR to its cognate antigen in the presence of said second CAR is 85%, 90%, 95%, 96%, 97%, 98% or 99% of binding of the antigen binding domain of said first CAR to its cognate antigen in the absence of said second CAR.

In some embodiments, when present on the surface of a cell, the antigen binding domains of said first CAR said second CAR, associate with one another less than if both were scFv antigen binding domains. In some embodiments, the antigen binding domains of said first CAR said second CAR, associate with one another 85%, 90%, 95%, 96%, 97%, 98% or 99% less than if both were scFv antigen binding domains.

In another aspect, the CAR-expressing cell described herein can further express another agent, e.g., an agent which enhances the activity of a CAR-expressing cell. For example, in one embodiment, the agent can be an agent which inhibits an inhibitory molecule. Inhibitory molecules, e.g., PD1, can, in some embodiments, decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAGS, VISTA, BTLA, TIGIT, LAIR1, CD160, 2B4 and TGF beta. In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta, or a fragment of any of these (e.g., at least a portion of an extracellular domain of any of these), and a second polypeptide which is an intracellular signaling domain described herein (e.g., comprising a costimulatory domain (e.g., 41BB, CD27 or CD28, e.g., as described herein, or a functional variant thereof) and/or a primary signaling domain (e.g., a CD3 zeta signaling domain described herein, or a functional variant thereof). In one embodiment, the agent comprises a first polypeptide of PD1 or a fragment thereof (e.g., at least a portion of an extracellular domain of PD1, or a functional variant thereof), and a second polypeptide of an intracellular signaling domain described herein (e.g., a CD28 signaling domain described herein and/or a CD3 zeta signaling domain described herein, or a functional variant thereof). PD1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD1, PD-L1 and PD-L2 have been shown to downregulate T cell activation upon binding to PD1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094) Immune suppression can be reversed by inhibiting the local interaction of PD1 with PD-L1.

In one embodiment, the agent comprises the extracellular domain (ECD) of an inhibitory molecule, e.g., Programmed Death 1 (PD1), fused to a transmembrane domain and intracellular signaling domains such as 41BB and CD3 zeta (also referred to herein as a PD1 CAR). In one embodiment, the PD1 CAR, when used in combinations with a XCAR described herein, improves the persistence of the T cell. In one embodiment, the CAR is a PD1 CAR comprising the extracellular domain of PD1 indicated as underlined in SEQ ID NO: 26. In one embodiment, the PD1 CAR comprises the amino acid sequence of SEQ ID NO:26.

```
                                          (SEQ ID NO: 26)
Malpvtalllplalllhaarppqwfldspdrpwnpptfspallvvtegdn atftcsfsntsesfvlnwyrmspsnqtdklaafpedrsqpqgdcrfrvtq lpngrdfhmsvvrarrndsqtylcgaislapkaqikeslraelrvterra evptahpspsprpagqfqtlvtttpaprpptpaptiasqplslrpeacrp aaggavhtrgldfacdiyiwaplagtcgvlllslvitlyckrgrkkllyi fkqpfmrpvqttqeedgcscrfpeeeeggcelrvkfsrsadapaykqgqn qlynelnlgrreeydvldkrrgrdpemggkprrknpqeglynelqkdkma eayseigmkgerrrgkghdglyqglstatkdtydalhmqalppr.
```

In one embodiment, the PD1 CAR comprises the amino acid sequence provided below (SEQ ID NO:39).

```
                                          (SEQ ID NO: 39)
pqwfldspdrpwnpptfspallvvtegdnatftcsfsntsesfylnwyrm spsnqtdklaafpedrsqpqgdcrfrvtqlpngrdfhmsvvrarrndsqt ylcgaislapkaqikeslraelrvterraevptahpspsprpagqfqtlv tttpaprpptpaptiasqplslrpeacrpaaggavhtrgldfacdiyiwa plagtcgvlllslvitlyckrgrkkllyifkqpfmrpvqttqeedgcscr fpeeeeggcelrvkfsrsadapaykqgqnqlynelnlgrreeydvldkrr grdpemggkprrknpqeglynelqkdkmaeayseigmkgerrrgkghdgl yqglstatkdtydalhmqalppr.
```

In one embodiment, the agent comprises a nucleic acid sequence encoding the PD1 CAR, e.g., the PD1 CAR described herein. In one embodiment, the nucleic acid sequence for the PD1 CAR is shown below, with the PD1 ECD underlined below in SEQ ID NO: 27

(SEQ ID NO: 27)
atggccctccctgtcactgccctgcttctcccctcgcactcctgctcca cgccgctagacca<u>cccggatggtttctggactctccggatcgcccgtgga</u>

<u>atccccaaccttctcaccggcactcttggttgtgactgagggcgataat</u>

<u>gcgaccttcacgtgctcgttctccaacacctccgaatcattcgtgctgaa</u>

<u>ctggtaccgcatgagcccgtcaaaccagaccgacaagctcgccgcgtttc</u>

<u>cggaagatcggtcgcaaccgggacaggattgtcggttccgcgtgactcaa</u>

<u>ctgccgaatggcagagacttccacatgagcgtggtccgcgctaggcgaaa</u>

<u>cgactccgggacctacctgtgcggagccatctcgctggcgcctaaggccc</u>

<u>aaatcaaagagagcttgagggccgaactgagagtgaccgagcgcagagct</u>

<u>gaggtgccaactgcacatccatccccatcgcctcggcctgcggggcagtt</u>

<u>tcagaccctggt</u>cacgaccactccggcgccgcgcccaccgactccggccc caactatcgcgagccagcccctgtcgctgaggccggaagcatgccgccct gccgccggaggtgctgtgcatacccggggattggacttcgcatgcgacat ctacatttgggctcctctcgccggaacttgtggcgtgctccttctgtccc tggtcatcaccctgtactgcaagcggggtcggaaaaagcttctgtacatt ttcaagcagcccttcatgaggcccgtgcaaaccacccaggaggaggacgg ttgctcctgccggttccccgaagaggaagaaggaggttgcgagctgcgcg tgaagttctcccggagcgccgacgcccccgcctataagcagggccagaac cagctgtacaacgaactgaacctgggacggcgggaagagtacgatgtgct ggacaagcggcgcggccgggaccccgaaatgggcgggaagcctagaagaa agaaccctcaggaaggcctgtataacgagctgcagaaggacaagatggcc gaggcctactccgaaattgggatgaagggagagcggcggaggggaaaggg gcacgacggcctgtaccaaggactgtccaccgccaccaaggacacatacg atgccctgcacatgcaggcccttcccctcgc.

In another aspect, the present invention provides a population of CAR-expressing cells, e.g., CART cells. In some embodiments, the population of CAR-expressing cells comprises a mixture of cells expressing different CARs. For example, in one embodiment, the population of CART cells can include a first cell expressing a CAR having an antigen binding domain to a cancer associated antigen described herein, and a second cell expressing a CAR having a different antigen binding domain, e.g., an antigen binding domain to a different a cancer associated antigen described herein, e.g., an antigen binding domain to a cancer associated antigen described herein that differs from the cancer associated antigen bound by the antigen binding domain of the CAR expressed by the first cell. As another example, the population of CAR-expressing cells can include a first cell expressing a CAR that includes an antigen binding domain to a cancer associated antigen described herein, and a second cell expressing a CAR that includes an antigen binding domain to a target other than a cancer associated antigen as described herein. In one embodiment, the population of CAR-expressing cells includes, e.g., a first cell expressing a CAR that includes a primary intracellular signaling domain, and a second cell expressing a CAR that includes a secondary signaling domain.

In another aspect, the present invention provides a population of cells wherein at least one cell in the population expresses a CAR having an antigen binding domain to a cancer associated antigen described herein, and a second cell expressing another agent, e.g., an agent which enhances the activity of a CAR-expressing cell. For example, in one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 or TGF beta, or a fragment of any of these, and a second polypeptide which is an intracellular signaling domain described herein (e.g., comprising a costimulatory domain (e.g., 41BB, CD27, OX40 or CD28, e.g., as described herein, or a functional variant thereof) and/or a primary signaling domain (e.g., a CD3 zeta signaling domain described herein, or a functional variant thereof). In one embodiment, the agent comprises a first polypeptide of PD-1 or a fragment thereof, and a second polypeptide of an intracellular signaling domain described herein (e.g., a CD28 signaling domain described herein, or a functional variant thereof, and/or a CD3 zeta signaling domain described herein, or a functional variant thereof).

In one aspect, the present invention provides methods comprising administering a population of CAR-expressing cells, e.g., CART cells, e.g., a mixture of cells expressing different CARs, in combination with another agent, e.g., a kinase inhibitor, such as a kinase inhibitor described herein. In another aspect, the present invention provides methods comprising administering a population of cells wherein at least one cell in the population expresses a CAR having an antigen binding domain of a cancer associated antigen described herein, and a second cell expressing another agent, e.g., an agent which enhances the activity of a CAR-expressing cell, in combination with another agent, e.g., a kinase inhibitor, such as a kinase inhibitor described herein.

Regulatable Chimeric Antigen Receptors

In some embodiments, a regulatable CAR (RCAR) where the CAR activity can be controlled is desirable to optimize the safety and efficacy of a CAR therapy. There are many ways CAR activities can be regulated. For example, inducible apoptosis using, e.g., a caspase fused to a dimerization domain (see, e.g., Di et al., N Egnl. J. Med. 2011 Nov. 3; 365(18):1673-1683), can be used as a safety switch in the CAR therapy of the instant invention. In an aspect, a RCAR comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain.

In an aspect, an RCAR comprises two polypeptides or members: 1) an intracellular signaling member comprising an intracellular signaling domain, e.g., a primary intracellular signaling domain described herein, and a first switch domain; 2) an antigen binding member comprising an antigen binding domain, e.g., that targets a tumor antigen described herein, as described herein and a second switch domain Optionally, the RCAR comprises a transmembrane domain described herein. In an embodiment, a transmembrane domain can be disposed on the intracellular signaling member, on the antigen binding member, or on both. (Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to a intracellular signaling domain can be different, e.g., reversed).

In an embodiment, the first and second switch domains can form an intracellular or an extracellular dimerization switch. In an embodiment, the dimerization switch can be a homodimerization switch, e.g., where the first and second switch domain are the same, or a heterodimerization switch, e.g., where the first and second switch domain are different from one another.

In embodiments, an RCAR can comprise a "multi switch." A multi switch can comprise heterodimerization switch domains or homodimerization switch domains. A multi switch comprises a plurality of, e.g., 2, 3, 4, 5, 6, 7, 8, 9, or 10, switch domains, independently, on a first member, e.g., an antigen binding member, and a second member, e.g., an intracellular signaling member. In an embodiment, the first member can comprise a plurality of first switch domains, e.g., FKBP-based switch domains, and the second member can comprise a plurality of second switch domains, e.g., FRB-based switch domains. In an embodiment, the first member can comprise a first and a second switch domain, e.g., a FKBP-based switch domain and a FRB-based switch domain, and the second member can comprise a first and a second switch domain, e.g., a FKBP-based switch domain and a FRB-based switch domain.

In an embodiment, the intracellular signaling member comprises one or more intracellular signaling domains, e.g., a primary intracellular signaling domain and one or more costimulatory signaling domains.

In an embodiment, the antigen binding member may comprise one or more intracellular signaling domains, e.g., one or more costimulatory signaling domains. In an embodiment, the antigen binding member comprises a plurality, e.g., 2 or 3 costimulatory signaling domains described herein, e.g., selected from 41BB, CD28, CD27, ICOS, and OX40, and in embodiments, no primary intracellular signaling domain. In an embodiment, the antigen binding member comprises the following costimulatory signaling domains, from the extracellular to intracellular direction: 41BB-CD27; 41BB-CD27; CD27-41BB; 41BB-CD28; CD28-41BB; OX40-CD28; CD28-OX40; CD28-41BB; or 41BB-CD28. In such embodiments, the intracellular binding member comprises a CD3zeta domain. In one such embodiment the RCAR comprises (1) an antigen binding member comprising, an antigen binding domain, a transmembrane domain, and two costimulatory domains and a first switch domain; and (2) an intracellular signaling domain comprising a transmembrane domain or membrane tethering domain and at least one primary intracellular signaling domain, and a second switch domain.

An embodiment provides RCARs wherein the antigen binding member is not tethered to the surface of the CAR cell. This allows a cell having an intracellular signaling member to be conveniently paired with one or more antigen binding domains, without transforming the cell with a sequence that encodes the antigen binding member. In such embodiments, the RCAR comprises: 1) an intracellular signaling member comprising: a first switch domain, a transmembrane domain, an intracellular signaling domain, e.g., a primary intracellular signaling domain, and a first switch domain; and 2) an antigen binding member comprising: an antigen binding domain, and a second switch domain, wherein the antigen binding member does not comprise a transmembrane domain or membrane tethering domain, and, optionally, does not comprise an intracellular signaling domain. In some embodiments, the RCAR may further comprise 3) a second antigen binding member comprising: a second antigen binding domain, e.g., a second antigen binding domain that binds a different antigen than is bound by the antigen binding domain; and a second switch domain.

Also provided herein are RCARs wherein the antigen binding member comprises bispecific activation and targeting capacity. In this embodiment, the antigen binding member can comprise a plurality, e.g., 2, 3, 4, or 5 antigen binding domains, e.g., scFvs, wherein each antigen binding domain binds to a target antigen, e.g. different antigens or the same antigen, e.g., the same or different epitopes on the same antigen. In an embodiment, the plurality of antigen binding domains are in tandem, and optionally, a linker or hinge region is disposed between each of the antigen binding domains. Suitable linkers and hinge regions are described herein.

An embodiment provides RCARs having a configuration that allows switching of proliferation. In this embodiment, the RCAR comprises: 1) an intracellular signaling member comprising: optionally, a transmembrane domain or membrane tethering domain; one or more co-stimulatory signaling domain, e.g., selected from 41BB, CD28, CD27, ICOS, and OX40, and a switch domain; and 2) an antigen binding member comprising: an antigen binding domain, a transmembrane domain, and a primary intracellular signaling domain, e.g., a CD3zeta domain, wherein the antigen binding member does not comprise a switch domain, or does not comprise a switch domain that dimerizes with a switch domain on the intracellular signaling member. In an embodiment, the antigen binding member does not comprise a co-stimulatory signaling domain. In an embodiment, the intracellular signaling member comprises a switch domain from a homodimerization switch. In an embodiment, the intracellular signaling member comprises a first switch domain of a heterodimerization switch and the RCAR comprises a second intracellular signaling member which comprises a second switch domain of the heterodimerization switch. In such embodiments, the second intracellular signaling member comprises the same intracellular signaling domains as the intracellular signaling member. In an embodiment, the dimerization switch is intracellular. In an embodiment, the dimerization switch is extracellular.

In any of the RCAR configurations described here, the first and second switch domains comprise a FKBP-FRB based switch as described herein.

Also provided herein are cells comprising an RCAR described herein. Any cell that is engineered to express a RCAR can be used as a RCARX cell. In an embodiment the RCARX cell is a T cell, and is referred to as a RCART cell. In an embodiment the RCARX cell is an NK cell, and is referred to as a RCARN cell.

Also provided herein are nucleic acids and vectors comprising RCAR encoding sequences. Sequence encoding various elements of an RCAR can be disposed on the same nucleic acid molecule, e.g., the same plasmid or vector, e.g., viral vector, e.g., lentiviral vector. In an embodiment, (i) sequence encoding an antigen binding member and (ii) sequence encoding an intracellular signaling member, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In an embodiment, a first promoter is operably linked to (i) and a second promoter is operably linked to (ii), such that (i) and (ii) are transcribed as separate mRNAs.

Alternatively, the sequence encoding various elements of an RCAR can be disposed on the different nucleic acid molecules, e.g., different plasmids or vectors, e.g., viral vector, e.g., lentiviral vector. E.g., the (i) sequence encoding an antigen binding member can be present on a first nucleic acid, e.g., a first vector, and the (ii) sequence encoding an intracellular signaling member can be present on the second nucleic acid, e.g., the second vector.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB,-based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) Identification of an 11-kDa FKBP12-rapamycin-binding domain within the 289-kDa FKBP12-rapamycin-associated protein and characterization of a critical serine residue. Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is as follows:

(SEQ ID NO: 52)
D V P D Y A S L G G P S S P K K K R K V S R G V Q

V E T I S P G D G R T F P K R G Q T C V V H Y T G M

L E D G K K F D S S R D R N K P F K F M L G K Q E

V I R G W E E G V A Q M S V G Q R A K L T I S P D

Y A Y G A T G H P G I I P P H A T L V F DV E L L K

L E T S Y

In embodiments, an FKBP switch domain can comprise a fragment of FKBP having the ability to bind with FRB, or a fragment or analog thereof, in the presence of rapamycin or a rapalog, e.g., the underlined portion of SEQ ID NO: 52, which is:

(SEQ ID NO: 53)
V Q V E T I S P G D G R T F P K R G Q T C V V H Y

T G M L E D G K K F D S S R DR N K P F K F M L G K

Q E V I R G W E E G V A Q M S V G Q R A K L T I S

P D Y AY G A T G H P G I I P P H A T L V F D V E

L L K L E T S

The amino acid sequence of FRB is as follows:

(SEQ ID NO: 54)
ILWHEMWHEG LEEASRLYFG ERNVKGMFEV LEPLHAMMER

GPQTLKETSF NQAYGRDLME AQEWCRKYMK SGNVKDLTQA

WDLYYHVFRR ISK

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 52 or 53; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 54. In an embodiment, a RCAR described herein comprises one switch domain comprises amino acid residues disclosed in SEQ ID NO: 52 (or SEQ ID NO: 53), and one switch domain comprises amino acid residues disclosed in SEQ ID NO: 54.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, S2035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 55, or leucine (E2032L), e.g., SEQ ID NO: 56. In an embodiment, a mutant FRB comprises a mutation at T2098, where T2098 is mutated to phenylalanine (T2098F) or leucine (T2098L), e.g., SEQ ID NO: 57. In an embodiment, a mutant FRB comprises a mutation at E2032 and at T2098, where E2032 is mutated to any amino acid, and where T2098 is mutated to any amino acid, e.g., SEQ ID NO: 58. In an embodiment, a mutant FRB comprises an E20321 and a T2098L mutation, e.g., SEQ ID NO: 59. In an embodiment, a mutant FRB comprises an E2032L and a T2098L mutation, e.g., SEQ ID NO: 60.

expressing a first CAR having a first antigen binding domain and a costimulatory domain (e.g., 41BB, or a functional variant thereof), and the cell also expresses a second CAR having a second antigen binding domain and an intracellular signaling domain (e.g., CD3 zeta, or a functional variant thereof). When the cell encounters the first antigen, the costimulatory domain is activated, and the cell proliferates. When the cell encounters the second antigen, the intracellular signaling domain is activated and cell-killing activity

TABLE 2

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHAMMERGPQTLKETSFN QAYGRDLMEAQEWCRKYMKSGNVKDLTQAWDLYYHVFRRISKTS | 55 |
| E2032L mutant | ILWHEMWHEGLLEASRLYFGERNVKGMFEVLEPLHAMMERGPQTLKETSFN QAYGRDLMEAQEWCRKYMKSGNVKDLTQAWDLYYHVFRRISKTS | 56 |
| T2098L mutant | ILWHEMWHEGLEEASRLYFGERNVKGMFEVLEPLHAMMERGPQTLKETSFN QAYGRDLMEAQEWCRKYMKSGNVKDLLQAWDLYYHVFRRISKTS | 57 |
| E2032, T2098 mutant | ILWHEMWHEGLXEASRLYFGERNVKGMFEVLEPLHAMMERGPQTLKETSFN QAYGRDLMEAQEWCRKYMKSGNVKDLXQAWDLYYHVFRRISKTS | 58 |
| E2032I, T2098L mutant | ILWHEMWHEGLIEASRLYFGERNVKGMFEVLEPLHAMMERGPQTLKETSFN QAYGRDLMEAQEWCRKYMKSGNVKDLLQAWDLYYHVFRRISKTS | 59 |
| E2032L, T2098L mutant | ILWHEMWHEGLLEASRLYFGERNVKGMFEVLEPLHAMMERGPQTLKETSFN QAYGRDLMEAQEWCRKYMKSGNVKDLLQAWDLYYHVFRRISKTS | 60 |

Other suitable dimerization switches include a GyrB-GyrB based dimerization switch, a Gibberellin-based dimerization switch, a tag/binder dimerization switch, and a halo-tag/snap-tag dimerization switch. Following the guidance provided herein, such switches and relevant dimerization molecules will be apparent to one of ordinary skill.

Dimerization Molecule

Association between the switch domains is promoted by the dimerization molecule. In the presence of dimerization molecule interaction or association between switch domains allows for signal transduction between a polypeptide associated with, e.g., fused to, a first switch domain, and a polypeptide associated with, e.g., fused to, a second switch domain. In the presence of non-limiting levels of dimerization molecule signal transduction is increased by 1.1, 1.2, 1.3, 1.4, 1.5, 1.6, 1.7, 1.8, 1.9, 2, 5, 10, 50, 100 fold, e.g., as measured in a system described herein.

Rapamycin and rapamycin analogs (sometimes referred to as rapalogues), e.g., RAD001, can be used as dimerization molecules in a FKBP/FRB-based dimerization switch described herein. In an embodiment the dimerization molecule can be selected from rapamycin (sirolimus), RAD001 (everolimus), zotarolimus, temsirolimus, AP-23573 (ridaforolimus), biolimus and AP21967. Additional rapamycin analogs suitable for use with FKBP/FRB-based dimerization switches are further described in the section entitled "Combination Therapies", or in the subsection entitled "Exemplary mTOR inhibitors".

Split CAR

In some embodiments, the CAR-expressing cell uses a split CAR. The split CAR approach is described in more detail in publications WO2014/055442 and WO2014/055657. Briefly, a split CAR system comprises a cell begins. Thus, the CAR-expressing cell is only fully activated in the presence of both antigens.

Exemplary CAR Molecules

The CAR molecules disclosed herein can comprise a binding domain that binds to a target, e.g., a target as described herein; a transmembrane domain, e.g., a transmembrane domain as described herein; and an intracellular signaling domain, e.g., an intracellular domain as described herein. In embodiments, the binding domain comprises a heavy chain complementary determining region 1 (HC CDR1), a heavy chain complementary determining region 2 (HC CDR2), and a heavy chain complementary determining region 3 (HC CDR3) of a heavy chain binding domain described herein, and/or a light chain complementary determining region 1 (LC CDR1), a light chain complementary determining region 2 (LC CDR2), and a light chain complementary determining region 3 (LC CDR3) of a light chain binding domain described herein.

CD19 CAR

In other embodiments, the CAR molecule comprises a CD19 CAR molecule described herein, e.g., a CD19 CAR molecule described in US-2015-0283178-A1, e.g., CTL019. In embodiments, the CD19 CAR comprises an amino acid, or has a nucleotide sequence shown in US-2015-0283178-A1, incorporated herein by reference, or a sequence substantially identical thereto (e.g., at least 85%, 90%, 95% or more identical thereto).

In one embodiment, the CAR T cell that specifically binds to CD19 has the USAN designation TISAGENLECLEU-CEL-T. CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In other embodiments, the CD19 CAR includes a CAR molecule, or an antigen binding domain (e.g., a humanized antigen binding domain) according to Table 3 of WO2014/153270, incorporated herein by reference. The amino acid and nucleotide sequences encoding the CD19 CAR molecules and antigen binding domains (e.g., including one, two, three VH CDRs; and one, two, three VL CDRs according to Kabat or Chothia), are specified in WO2014/153270. In embodiments, the CD19 CAR comprises an amino acid, or has a nucleotide sequence shown in WO2014/153270 incorporated herein by reference, or a sequence substantially identical to any of the aforesaid sequences (e.g., at least 85%, 90%, 95% or more identical to any of the aforesaid CD19 CAR sequences).

In one embodiment, the parental murine scFv sequence is the CAR19 construct provided in PCT publication WO2012/079000 (incorporated herein by reference) and provided herein in Table 3. In one embodiment, the anti-CD19 binding domain is a scFv described in WO2012/079000 and provided herein in Table 3.

In one embodiment, the CD19 CAR comprises an amino acid sequence provided as SEQ ID NO: 12 in PCT publication WO2012/079000. In embodiment, the amino acid sequence is:

MALPVTALLLPLALLLHAARPdiqmtqttssl-saslgdrvtiscrasqdiskylnwyqqkpdgtvklli yhtsrlhsgvpsrfsgsgsgtdysltisnleqediatyfcqqgntlpy-tfgggtkleitggggsggggsggggsevklqesgpglva psqslsvtctvsgvslpdygvswirqpprkglewlgviwgsettyyn-salksrltiikdnsksqvflkmnslqtddtaiyycakh yyyggsyamdywgqgtsvtvssttttpaprpptpaptiasqplslrpeacr-paaggavhtrgldfacdiyiwaplagtcgvlllslv itlyckrgrkklly-ifkqpfmrpvqttqeedgcscrfpeeeeggcelrvkfsrsadapa-ykqgqnqlynelnlgrreeydvldkrr grdpemggkprrknpqeglynelqkdkmaeayseigmkgerrrgkghdg-lyqglstatkdtydalhmqalppr (SEQ ID NO: 891), or a sequence substantially identical thereto (e.g., at least 85%, 90% or 95% or higher identical thereto), with or without the signal peptide sequence indicated in capital letters.

In embodiment, the amino acid sequence is:
diqmtqttsslsaslgdrvtiscrasqdisky-lnwyqqkpdgtvklliyhtsrlhsgvpsrfsgsgsgtdysltisnleqe diatyfcqqgntlpytfgggtkleitggggsggggsgggg-sevklqesgpglvapsqslsvtctvsgvslpdygvswirqpprkg lew-lgviwgsettyynsalksrltiikdnsksqvflkmnslqtddtaiyy-cakhyyyggsyamdywgqgtsvtvssttttpaprp ptpaptiasqplslrpeacrpaaggavhtrgldfacdiyi-waplagtcgvlllslvitlyckrgrkkllyifkqpfmrpvqttqeedg cscrfpeeeeggcelrvkfsrsadapaykqgqnqlynelnlgrreeydvldlar-grdpemggkprrknpqeglynelqkdkm aeayseigmkgerrrgkghdg-lyqglstatkdtydalhmqalppr (SEQ ID NO: 892), or a sequence substantially homologous thereto (e.g., at least 85%, 90% or 95% or higher identical thereto).

In embodiments, the CAR molecule is a CD19 CAR molecule described herein, e.g., a humanized CAR molecule described herein, e.g., a humanized CD19 CAR molecule of Table 3 or having CDRs as set out in Tables 4A and 4B.

In embodiments, the CAR molecule is a CD19 CAR molecule described herein, e.g., a murine CAR molecule described herein, e.g., a murine CD19 CAR molecule of Table 3 or having CDRs as set out in Tables 4A and 4B.

In some embodiments, the CAR molecule comprises one, two, and/or three CDRs from the heavy chain variable region and/or one, two, and/or three CDRs from the light chain variable region of the murine or humanized CD19 CAR of Tables 4A and 4B.

In one embodiment, the antigen binding domain comprises one, two three (e.g., all three) heavy chain CDRs, HC CDR1, HC CDR2 and HC CDR3, from an antibody listed herein, and/or one, two, three (e.g., all three) light chain CDRs, LC CDR1, LC CDR2 and LC CDR3, from an antibody listed herein. In one embodiment, the antigen binding domain comprises a heavy chain variable region and/or a variable light chain region of an antibody listed or described herein.

Exemplary CD19 CARs include any of the CD19 CARs or anti-CD19 binding domains described herein, e.g., in one or more tables (e.g., Table 3) described herein (e.g., or an anti-CD19 CAR described in Xu et al. Blood 123.24(2014): 3750-9; Kochenderfer et al. Blood 122.25(2013):4129-39, Cruz et al. Blood 122.17(2013):2965-73, NCT00586391, NCT01087294, NCT02456350, NCT00840853, NCT02659943, NCT02650999, NCT02640209, NCT01747486, NCT02546739, NCT02656147, NCT02772198, NCT00709033, NCT02081937, NCT00924326, NCT02735083, NCT02794246, NCT02746952, NCT01593696, NCT02134262, NCT01853631, NCT02443831, NCT02277522, NCT02348216, NCT02614066, NCT02030834, NCT02624258, NCT02625480, NCT02030847, NCT02644655, NCT02349698, NCT02813837, NCT02050347, NCT01683279, NCT02529813, NCT02537977, NCT02799550, NCT02672501, NCT02819583, NCT02028455, NCT01840566, NCT01318317, NCT01864889, NCT02706405, NCT01475058, NCT01430390, NCT02146924, NCT02051257, NCT02431988, NCT01815749, NCT02153580, NCT01865617, NCT02208362, NCT02685670, NCT02535364, NCT02631044, NCT02728882, NCT02735291, NCT01860937, NCT02822326, NCT02737085, NCT02465983, NCT02132624, NCT02782351, NCT01493453, NCT02652910, NCT02247609, NCT01029366, NCT01626495, NCT02721407, NCT01044069, NCT00422383, NCT01680991, NCT02794961, or NCT02456207, each of which is incorporated herein by reference in its entirety.

Exemplary CD19 CAR and antigen binding domain constructs that can be used in the methods described herein are shown in Table 3. The light and heavy chain CDR sequences according to Kabat are shown by the bold and underlined text, and are also summarized in Tables 3 and 4A-4B below. The location of the signal sequence and histidine tag are also underlined. In embodiments, the CD19 CAR sequences and antigen binding fragments thereof do not include the signal sequence and/or histidine tag sequences.

In embodiments, the CD19 CAR comprises an anti-CD19 binding domain (e.g., murine or humanized anti-CD19 binding domain), a transmembrane domain, and an intracellular signaling domain, and wherein said anti-CD19 binding domain comprises a heavy chain complementary determining region 1 (HC CDR1), a heavy chain complementary determining region 2 (HC CDR2), and a heavy chain complementary determining region 3 (HC CDR3) of any anti-CD19 heavy chain binding domain amino acid sequences listed in Table 3 and 4A-4B, or a sequence at least 85%, 90%, 95% or more identical thereto (e.g., having less than 5, 4, 3, 2 or 1 amino acid substitutions, e.g., conservative substitutions).

In one embodiment, the anti-CD19 binding domain comprises a light chain variable region described herein (e.g., in Table 3) and/or a heavy chain variable region described herein (e.g., in Table 3), or a sequence at least 85%, 90%, 95% or more identical thereto.

In one embodiment, the encoded anti-CD19 binding domain is a scFv comprising a light chain and a heavy chain of an amino acid sequence of Tables 3, or a sequence at least 85%, 90%, 95% or more identical thereto.

In an embodiment, the human or humanized anti-CD19 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 3, or a sequence at least 85%, 90%, 95% or more identical thereto; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 3, or a sequence at least 85%, 90%, 95% or more identical thereto.

TABLE 3

CD19 CAR Constructs

| Name | SEQ ID NO: | Sequence |
|---|---|---|
| CAR 1 | | |
| CAR1 scFv domain | 893 | EIVMTQSPATLSLSPGERATLSCRASQDISKYLNWYQQKPGQAPRLLIYH TSRLHSGIPARFSGSGSGTDYTLTISSLQPEDFAVYFCQQGNTLPYTFGQ GTKLEIKGGGGSGGGGSGGGGSQVQLQESGPGLVKPSETLSLTCTVSGVS LPDYGVSWIRQPPGKGLEWIGVIWGSETTYYSSSLKSRVTISKDNSKNQV SLKLSSVTAADTAVYYCAKHYYYGGSYAMDYWGQGTLVTVSS |
| 103101 CAR1 Soluble scFv-nt | 894 | atggccctccctgtcaccgccctgctgcttccgctggctcttctgctcca cgccgctcggcccgaaattgtgatgacccagtcacccgccactcttagcc tttcacccggtgagcgcgcaaccctgtcttgcagagcctcccaagacatc tcaaaatacccttaattggtatcaacagaagcccggacaggctcctcgcct tctgatctaccacaccagccggctccattctggaatcctgccaggttca gcggtagcggatctgggaccgactacaccctcactatcagctcactgcag ccagaggacttcgctgtctatttctgtcagcaagggaacaccctgccccta cacctttggacagggcaccaagctcgagattaaaggtggaggtggcagcg gaggaggtgggtccggcggtggaggaagccaggtccaactccaagaaagc ggacccgggtcttgtgaagccatcagaaactctttcactgacttgtactgt gagcggagtgtctctccccgattacggggtgtcttggatcagacagccac cggggaagggtctggaatggattggagtgatttgggctctgagactact tactactcttcatccctcaagtcacgcgtcaccatctcaaaggacaactc taagaatcaggtgtcactgaaactgtcatctgtgaccgcagccgacaccg ccgtgtactattgcgctaagcattactattatggcgggagctacgcaatg gattactggggacagggtactctggtcaccgtgtccagccaccaccatca tcaccatcaccat |
| 103101 CAR1 Soluble scFv-aa | 895 | MALPVTALLLPLALLLHAARPeivmtqspatlslspgeratlscrasqdi skylnwyqqkpgqaprlliyhtsrlhsgiparfsgsgsgtdytltisslq pedfavyfcqqgntlpytfgqgtkleikggggsggggsggggsqvqlqes gpglvkpsetlsltctvsgvslpdygvswirqppgkglewigviwgsett yyssslksrvtiskdnsknqvslklssvtaadtavyycakhyyyggsyam dywgqgtlvtvsshhhhhhhh |
| 104875 CAR 1-Full-nt | 896 | atggccctccctgtcaccgccctgctgcttccgctggctcttctgctcca cgccgctcggcccgaaattgtgatgacccagtcacccgccactcttagcc tttcacccggtgagcgcgcaaccctgtcttgcagagcctcccaagacatc tcaaaatacccttaattggtatcaacagaagcccggacaggctcctcgcct tctgatctaccacaccagccggctccattctggaatcctgccaggttca gcggtagcggatctgggaccgactacaccctcactatcagctcactgcag ccagaggacttcgctgtctatttctgtcagcaagggaacaccctgccccta cacctttggacagggcaccaagctcgagattaaaggtggaggtggcagcg gaggaggtgggtccggcggtggaggaagccaggtccaactccaagaaagc ggacccgggtcttgtgaagccatcagaaactctttcactgacttgtactgt gagcggagtgtctctccccgattacggggtgtcttggatcagacagccac cggggaagggtctggaatggattggagtgatttgggctctgagactact tactactcttcatccctcaagtcacgcgtcaccatctcaaaggacaactc taagaatcaggtgtcactgaaactgtcatctgtgaccgcagccgacaccg ccgtgtactattgcgctaagcattactattatggcgggagctacgcaatg gattactggggacagggtactctggtcaccgtgtccagccaccactacccc agcaccgaggccacccaccccggctcctaccatcgcctccagcctctgt ccctgcgtccgaggcatgtagacccgcagctggtggggccgtgcatacc cggggtcttgacttcgcctgcgatatctacatttgggcccctctggctgg tacttgcggggtcctgctgcttcactcgtgatcactctttactgtaagc gcggtcggaagaagctgctgtacatctttaagcaaccctcatgaggcct gtgcagactactcaagaggaggacggctgttcatgccggttcccagagga ggaggaaggcggctgcgaactgcgcgtgaaattcagccgcagcgcagatg ctccagcctacaagcagggcagaaccagctctacaacgaactcaatctt ggtcggagagaggagtacgacgtgctggacaagcggagaggacgggaccc |

TABLE 3-continued

| | | CD19 CAR Constructs |
|---|---|---|
| Name | SEQ ID NO: | Sequence |
| | | agaaatgggcgggaagccgcgcagaaagaatcccaagagggcctgtaca<br>acgagctccaaaaggataagatggcagaagcctatagcgagattggtatg<br>aaaggggaacgcagaagaggcaaaggccacgacggactgtaccagggact<br>cagcaccgccaccaaggacacctatgacgctcttcacatgcaggccctgc<br>cgcctcgg |
| 104875<br>CAR 1-<br>Full-aa | 897 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsqvqlqes<br>gpglvkpsetlsltctvsgvslpdygvswirqppgkglewigviwgsett<br>yyssslksrvtiskdnsknqvslklssvtaadtavyycakhyyyggsyam<br>dywgqgtlvtvsstttpaprpptpaptiasqplslrpeacrpaaggavht<br>rgldfacdiyiwaplagtcgvlllslvitlyckrgrkkllyifkqpfmrp<br>vqttqeedgcscrfpeeeeggcelrvkfsrsadapaykqggnqlynelnl<br>grreeydvldkrrgrdpemggkprrknpqeglynelqkdkmaeayseigm<br>kgerrrgkghdglyqglstatkdtydalhmqalppr |
| | | CAR 2 |
| CAR2 scFv<br>domain | 898 | eivmtqspatlslspgeratlscrasqdiskylnwyqqkpgqaprlliyh<br>tsrlhsgiparfsgsgsgtdytltisslqpedfavyfcqqgntlpytfgq<br>gtkleikggggsggggsggggsqvqlqesgpglvkpsetlsltctvsgvs<br>lpdygvswirqppgkglewigviwgsettyyqslksrvtiskdnsknqv<br>slklssvtaadtavyycakhyyyggsyamdywgqgtlvtvss |
| 103102<br>CAR2-<br>Soluble<br>scFv-nt | 899 | atggccctccctgtcaccgccctgctgcttccgctggctcttctgctcca<br>cgccgctcggcccgaaattgtgatgacccagtcacccgccactcttagcc<br>tttcaccggtgagcgcgcaaccctgtcttgcagagcctcccaagacatc<br>tcaaataaccttaattggtatcaacagaagcccgacaggctcctcgcct<br>tctgatctaccacaccagccggctccattctggaatccctgccaggttca<br>gcggtagcggatctgggaccgactacaccctcactatcagctcactgcag<br>ccagaggacttcgctgtctatttctgtcagcaagggaacaccctgcccta<br>caccctttggacaggcaccaagctcgagattaaaggtggaggtggcagcg<br>gaggaggtgggtccggcggtggaggaagccaggtccaactccaagaaagc<br>ggaccgggtcttgtgaagccatcagaaactctttcactgacttgtactgt<br>gagcggagtgtctctccccgattacggggtgtcttggatcagacagccac<br>cggggaagggtctggaatggattggagtgatttgggctctgagactact<br>tactaccaatcatccctcaagtcacgcgtcaccatctcaaaggacaactc<br>taagaatcaggtgtcactgaaactgtcatctgtgaccgcagccgacaccg<br>ccgtgtactattgcgctaagcattactattatggcgggagctacgcaatg<br>gattactggggacagggtactctggtcaccgtgtccagccaccaccatca<br>tcaccatcaccat |
| 103102<br>CAR2-<br>Soluble<br>scFv-aa | 900 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsqvqlqes<br>gpglvkpsetlsltctvsgvslpdygvswirqppgkglewigviwgsett<br>yyqsslksrvtiskdnsknqvslklssvtaadtavyycakhyyyggsyam<br>dywgqgtlvtvsshhhhhhhh |
| 104876<br>CAR 2-<br>Full-nt | 901 | atggccctccctgtcaccgccctgctgcttccgctggctcttctgctcca<br>cgccgctcggcccgaaattgtgatgacccagtcacccgccactcttagcc<br>tttcaccggtgagcgcgcaaccctgtcttgcagagcctcccaagacatc<br>tcaaataaccttaattggtatcaacagaagcccgacaggctcctcgcct<br>tctgatctaccacaccagccggctccattctggaatccctgccaggttca<br>gcggtagcggatctgggaccgactacaccctcactatcagctcactgcag<br>ccagaggacttcgctgtctatttctgtcagcaagggaacaccctgcccta<br>caccctttggacaggcaccaagctcgagattaaaggtggaggtggcagcg<br>gaggaggtgggtccggcggtggaggaagccaggtccaactccaagaaagc<br>ggaccgggtcttgtgaagccatcagaaactctttcactgacttgtactgt<br>gagcggagtgtctctccccgattacggggtgtcttggatcagacagccac<br>cggggaagggtctggaatggattggagtgatttgggctctgagactact<br>tactaccaatcatccctcaagtcacgcgtcaccatctcaaaggacaactc<br>taagaatcaggtgtcactgaaactgtcatctgtgaccgcagccgacaccg<br>ccgtgtactattgcgctaagcattactattatggcgggagctacgcaatg<br>gattactggggacagggtactctggtcaccgtgtccagccaccactacccc<br>agcaccgaggccacccaccccggctcctaccatcgcctcccagcctctgt<br>ccctgcgtccggaggcatgtagacccgcagctggtggggccgtgcatacc<br>cggggtcttgacttcgcctgcgatatctacatttgggcccctctggctgg<br>tacttgcggggtcctgctgctttcactcgtgatcactcttactgtaagc<br>gcggtcggaagaagctgctgtacatctttaagcaacccttcatgaggcct<br>gtgcagactactcaagaggaggacggctgttcatgccggttcccagagga<br>ggaggaaggcggctgcgaactgcgcgtgaaattcagccgcagcgcagatg<br>ctccagcctacaagcaggggcagaaccagctctcaaacgaactcaatcttt<br>ggtcggagagaggagtacgacgtgctggacaagcggagaggacgggaccc |

TABLE 3-continued

| | | CD19 CAR Constructs |
|---|---|---|
| Name | SEQ ID NO: | Sequence |
| | | agaaatgggcgggaagccgcgcagaaagaatcccaagagggcctgtaca<br>acgagctccaaaaggataagatggcagaagcctatagcgagattggtatg<br>aaaggggaacgcagaagaggcaaaggccacgacggactgtaccagggact<br>cagcaccgccaccaaggacacctatgacgctcttcacatgcaggccctgc<br>cgcctcgg |
| 104876<br>CAR 2-<br>Full-aa | 902 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsqvqlqes<br>gpglvkpsetlsltctvsgvslpdygvswirqppgkglewigviwgsett<br>yyqsslksrvtiskdnsknqvslklssvtaadtavyycakhyyyggsyam<br>dywgqgtlvtvsstttpaprpptpaptiasqplslrpeacrpaaggavht<br>rgldfacdiyiwaplagtcgvlllslvitlyckrgrkkllyifkqpfmrp<br>vqttqeedgcscrfpeeeeggcelrvkfsrsadapaykqgqnqlynelnl<br>grreeydvldkrrgrdpemggkprrknpqeglynelqkdkmaeayseigm<br>kgerrrgkghdglyqglstatkdtydalhmqalppr |
| | | CAR 3 |
| CAR3 scFv<br>domain | 903 | qvqlqesgpglvkpsetlsltctvsgvslpdygvswirqppgkglewigv<br>iwgsettyyssslksrvtiskdnsknqvslklssvtaadtavyycakhyy<br>yggsyamdywgqgtlvtvssggggsggggsggggseivmtqspatlslsp<br>geratlscrasqdiskylnwyqqkpgqaprlliyhtsrlhsgiparfsgs<br>gsgtdytltisslqpedfavyfcqqgntlpytfgqgtkleik |
| 103104<br>CAR 3-<br>Soluble<br>scFv-nt | 904 | atggctctgcccgtgaccgcactcctcctgccactggctctgctgcttca<br>cgccgctcgcccacaagtccagcttcaagaatcagggcctggtctggtga<br>agccatctgagactctgtccctcacttgcaccgtgagcggagtgtccctc<br>ccagactacggagtgagctggattagacagcctcccggaaagggactgga<br>gtggatcggagtgatttggggtagcgaaaccacttactattcatcttccc<br>tgaagtcacgggtcaccatttcaaaggataactcaaagaatcaagtgagc<br>ctcaagctctcatcagtcaccgccgctgacaccgccgtgtattactgtgc<br>caagcattactactatggagggtcctacgccatggactactggggccagg<br>gaactctggtcactgtgtcatctggtggaggaggtagcggaggaggcggg<br>agcggtggaggtggctccgaaatcgtgatgacccagagccctgcaaccct<br>gtcccttctccggggaacggctaccctttcttgtcgggcatcacaag<br>atatctcaaaataccttcaattggtatcaacagaagccgggacaggcccct<br>aggcttcttatctaccacacctctcgcctgcatagcgggattcccgcacg<br>ctttagcgggtctggaagcgggaccgactacactctgaccatctcatctc<br>tccagcccgaggacttcgccgtctacttctgccagcagggtaacaccctg<br>ccgtacaccttcggccagggcaccaagcttgagatcaaacatcaccacca<br>tcatcaccatcac |
| 103104<br>CAR 3-<br>Soluble<br>scFv-aa | 905 | MALPVTALLLPLALLLHAARPqvqlqesgpglvkpsetlsltctvsgvsl<br>pdygvswirqppgkglewigviwgsettyyssslksrvtiskdnsknqvs<br>lklssvtaadtavyycakhyyyggsyamdywgqgtlvtvssggggsgggg<br>sggggseivmtqspatlslspgeratlscrasqdiskylnwyqqkpgqap<br>rlliyhtsrlhsgiparfsgsgsgtdytltisslqpedfavyfcqqgntl<br>pytfgqgtkleikhhhhhhhh |
| 104877<br>CAR 3-<br>Full-nt | 906 | atggctctgcccgtgaccgcactcctcctgccactggctctgctgcttca<br>cgccgctcgcccacaagtccagcttcaagaatcagggcctggtctggtga<br>agccatctgagactctgtccctcacttgcaccgtgagcggagtgtccctc<br>ccagactacggagtgagctggattagacagcctcccggaaagggactgga<br>gtggatcggagtgatttggggtagcgaaaccacttactattcatcttccc<br>tgaagtcacgggtcaccatttcaaaggataactcaaagaatcaagtgagc<br>ctcaagctctcatcagtcaccgccgctgacaccgccgtgtattactgtgc<br>caagcattactactatggagggtcctacgccatggactactggggccagg<br>gaactctggtcactgtgtcatctggtggaggaggtagcggaggaggcggg<br>agcggtggaggtggctccgaaatcgtgatgacccagagccctgcaaccct<br>gtcccttctccggggaacggctaccctttcttgtcgggcatcacaag<br>atatctcaaaataccttcaattggtatcaacagaagccgggacaggcccct<br>aggcttcttatctaccacacctctcgcctgcatagcgggattcccgcacg<br>ctttagcgggtctggaagcgggaccgactacactctgaccatctcatctc<br>tccagcccgaggacttcgccgtctacttctgccagcagggtaacaccctg<br>ccgtacaccttcggccagggcaccaagcttgagatcaaaccactactcc<br>cgctccaaggccacccaccccctgccccgaccatcgcctctcagccgcttt<br>ccctgcgtccggaggcatgtagacccgcagctggtggggccgtgcatacc<br>cggggtcttgacttcgcctgcgatatctacatttgggcccctctggctgg<br>tacttgcggggtcctgctgctttcactcgtgatcactcttactgtaagc<br>gcggtcgaagaagctgctgtacatctttaagcaacccttcatgaggcct<br>gtgcagactactcaagaggaggacggctgttcatgccggttcccagagga<br>ggaggaaggcggctgcgaactgcgcgtgaaattcagccgcagcgcagatg<br>ctccagcctacaagcaggggcagaaccagctctcaaacgaactcaatctt<br>ggtcggagagaggagtacgacgtgctggacaagcggagaggacgggaccc |

TABLE 3-continued

CD19 CAR Constructs

| Name | SEQ ID NO: | Sequence |
|---|---|---|
| | | agaaatgggcgggaagccgcgcagaaagaatcccaagagggcctgtaca<br>acgagctccaaaaggataagatggcagaagcctatagcgagattggtatg<br>aaaggggaacgcagaagaggcaaaggccacgacggactgtaccagggact<br>cagcaccgccaccaaggacacctatgacgctcttcacatgcaggccctgc<br>cgcctcgg |
| 104877<br>CAR 3-<br>Full-aa | 907 | MALPVTALLLPLALLLHAARPqvqlqesgpglvkpsetlsltctvsgvsl<br>pdygvswirqppgkglewigviwgsettyyssslksrvtiskdnsknqvs<br>lklssvtaadtavyycakhyyyggsyamdywgqgtlvtvssggggsgggg<br>sggggseivmtqspatlslspgeratlscrasqdiskylnwyqqkpgqap<br>rlliyhtsrlhsgiparfsgsgsgtdytltisslqpedfavyfcqqgntl<br>pytfgqgtkleiktttpaprpptpaptiasqplslrpeacrpaaggavht<br>rgldfacdiyiwaplagtcgvlllslvitlyckrgrkkllyifkqpfmrp<br>vqttqeedgcscrfpeeeeggcelrvkfsrsadapaykqgqnqlyneinl<br>grreeydvldkrrgrdpemggkprrknpqeglynelqkdkmaeayseigm<br>kgerrrgkghdglyqglstatkdtydalhmqalppr |

CAR 4

| CAR4 scFv<br>domain | 908 | qvqlqesgpglvkpsetlsltctvsgvslpdygvswirqppgkglewigv<br>iwgsettyyqsslksrvtiskdnsknqvslklssvtaadtavyycakhyy<br>yggsyamdywgqgtlvtvssggggsggggsggggseivmtqspatlslsp<br>geratlscrasqdiskylnwyqqkpgqaprlliyhtsrlhsgiparfsgs<br>gsgtdytltisslqpedfavyfcqqgntlpytfgqgtkleik |
| 103106<br>CAR4-<br>Soluble<br>scFv-nt | 909 | atggctctgcccgtgaccgcactcctcctgccactggctctgctgcttca<br>cgccgctcgcccacaagtccagcttcaagaatcagggcctggtctggtga<br>agccatctgagactctgtccctcacttgcaccgtgagcggagtgtccctc<br>ccagactacggagtgagctggattagacagcctcccggaaagggactgga<br>gtggatcggagtgatttggggtagcgaaaccacttactatcaatcttccc<br>tgaagtcacgggtcaccatttcaaaggataactcaaagaatcaagtgagc<br>ctcaagctctcatcagtcaccgccgctgacaccgccgtgtattactgtgc<br>caagcattactactatggagggtcctacgccatggactactggggccagg<br>gaactctggtcactgtgtcatctggtggaggaggtagcggaggaggcggg<br>agcggtggaggtggctccgaaatcgtgatgacccagagccctgcaaccct<br>gtcccttcctcccggggaacggctaccctttcttgtcgggcatcacaag<br>atatctcaaaatacctcaattggtatcaacagaagccgggacaggcccct<br>aggcttcttatctaccacacctctcgcctgcatagcgggattcccgcacg<br>ctttagcgggtctggaagcgggaccgactacactctgaccatctcatctc<br>tccagcccgaggacttcgccgtctacttctgccagcagggtaacaccctg<br>ccgtacaccttcggccagggcaccaagcttgagatcaaacatcaccacca<br>tcatcaccatcac |
| 103106<br>CAR4-<br>Soluble<br>scFv-aa | 910 | MALPVTALLLPLALLLHAARPqvqlqesgpglvkpsetlsltctvsgvsl<br>pdygvswirqppgkglewigviwgsettyyqsslksrvtiskdnsknqvs<br>lklssvtaadtavyycakhyyyggsyamdywgqgtlvtvssggggsgggg<br>sggggseivmtqspatlslspgeratlscrasqdiskylnwyqqkpgqap<br>rlliyhtsrlhsgiparfsgsgsgtdytltisslqpedfavyfcqqgntl<br>pytfgqgtkleikhhhhhhhh |
| 104878<br>CAR 4-<br>Full-nt | 911 | atggctctgcccgtgaccgcactcctcctgccactggctctgctgcttca<br>cgccgctcgcccacaagtccagcttcaagaatcagggcctggtctggtga<br>agccatctgagactctgtccctcacttgcaccgtgagcggagtgtccctc<br>ccagactacggagtgagctggattagacagcctcccggaaagggactgga<br>gtggatcggagtgatttggggtagcgaaaccacttactatcaatcttccc<br>tgaagtcacgggtcaccatttcaaaggataactcaaagaatcaagtgagc<br>ctcaagctctcatcagtcaccgccgctgacaccgccgtgtattactgtgc<br>caagcattactactatggagggtcctacgccatggactactggggccagg<br>gaactctggtcactgtgtcatctggtggaggaggtagcggaggaggcggg<br>agcggtggaggtggctccgaaatcgtgatgacccagagccctgcaaccct<br>gtcccttcctcccggggaacggctaccctttcttgtcgggcatcacaag<br>atatctcaaaatacctcaattggtatcaacagaagccgggacaggcccct<br>aggcttcttatctaccacacctctcgcctgcatagcgggattcccgcacg<br>ctttagcgggtctggaagcgggaccgactacactctgaccatctcatctc<br>tccagcccgaggacttcgccgtctacttctgccagcagggtaacaccctg<br>ccgtacaccttcggccagggcaccaagcttgagatcaaaaccactactcc<br>cgctccaaggccacccaccccctgccccgaccatcgcctctcagccgcttt<br>ccctgcgtccggaggcatgtagacccgcagctggtggggccgtgcatacc<br>cggggtcttgacttcgcctgcgatatctacatttgggcccctctggctgg<br>tacttgcggggtcctgctgctttcactcgtgatcactcttactgtaagc<br>gcggtcggaagaagctgctgtacatctttaagcaacccttcatgaggcct<br>gtgcagactactcaagaggaggacggctgttcatgccggttcccagagga<br>ggaggaaggcggctgcgaactgcgcgtgaaattcagccgcagcgcagatg<br>ctccagcctacaagcaggggcagaaccagctctcaaacgaactcaatctt<br>ggtcggagagaggagtacgacgtgctggacaagcggagaggacgggaccc |

TABLE 3-continued

CD19 CAR Constructs

| Name | SEQ ID NO: | Sequence |
|---|---|---|
| | | agaaatgggcgggaagccgcgcagaaagaatcccaagagggcctgtaca<br>acgagctccaaaaggataagatggcagaagcctatagcgagattggtatg<br>aaaggggaacgcagaagaggcaaaggccacgacggactgtaccagggact<br>cagcaccgccaccaaggacacctatgacgctcttcacatgcaggccctgc<br>cgcctcgg |
| 104878<br>CAR 4-<br>Full-aa | 912 | MALPVTALLLPLALLLHAARPqvqlqesgpglvkpsetlsltctvsgvsl<br>pdygvswirqppgkglewigviwgsettyyqsslksrvtiskdnsknqvs<br>lklssvtaadtavyycakhyyyggsyamdywgqgtlvtvssggggsgggg<br>sggggseivmtqspatlslspgeratlscrasqdiskylnwyqqkpgqap<br>rlliyhtsrlhsgiparfsgsgsgtdytltisslqpedfavyfcqqgntl<br>pytfgqgtkleiktttpaprpptpaptiasqplslrpeacrpaaggavht<br>rgldfacdiyiwaplagtcgvlllslvitlyckrgrkkllyifkqpfmrp<br>vqttqeedgcscrfpeeeeggcelrvkfsrsadapaykqggnqlynelnl<br>grreeydvldkrrgrdpemggkprrknpqeglynelqkdkmaeayseigm<br>kgerrrgkghdglyqglstatkdtydalhmqalppr |

CAR 5

| Name | SEQ ID NO: | Sequence |
|---|---|---|
| CAR5 scFv<br>domain | 913 | eivmtqspatlslspgeratlscrasqdiskylnwyqqkpgqaprlliyh<br>tsrlhsgiparfsgsgsgtdytltisslqpedfavyfcqqgntlpytfgq<br>gtkleikggggsggggsggggsggggsqvqlqesgpglvkpsetlsltct<br>vsgvslpdygvswirqppgkglewigviwgsettyyssslksrvtiskdn<br>sknqvslklssvtaadtavyycakhyyyggsyamdywgqgtlvtvss |
| 99789<br>CAR5-<br>Soluble<br>scFv-nt | 914 | atggccctcccagtgaccgctctgctgctgcctctcgcacttcttctcca<br>tgccgctcggcctgagatcgtcatgacccaaagccccgctaccctgtccc<br>tgtcaccggcgagagggcaacccttcatgcagggccagccaggacatt<br>tctaagtacctcaactggtatcagcagaagccagggcaggctcctcgcct<br>gctgatctaccacaccagccgcctccacagcggtatccccgccagatttt<br>ccgggagcgggtctggaaccgactacaccctcaccatctcttctctgcag<br>cccgaggatttcgccgtctatttctgccagcaggggaatactctgccgta<br>caccttcggtcaaggtaccaagctggaaatcaagggaggcggaggatcag<br>gcggtggcggaagcggaggaggtggctccggaggaggaggttccaagtg<br>cagcttcaagaatcaggacccggacttgtgaagccatcagaaaccctctc<br>cctgacttgtaccgtgtccggtgtgagcctccccgactacggagtctctt<br>ggattcgccagcctccgggaaggtcttgaatggattgggtgatttgg<br>ggatcagagactacttactactcttcatcacttaagtcacgggtcaccat<br>cagcaaagataatagcaagaaccaagtgtcacttaagctgtcatctgtga<br>ccgccgctgacaccgccgtgtactattgtgccaaacattactattacgga<br>gggtcttatgctatggactactggggacaggggaccctggtgactgtctc<br>tagccatcaccatcaccaccatcac |
| 99789<br>CAR5-<br>Soluble<br>scFv-aa | 915 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsggggsqv<br>qlqesgpglvkpsetlsltctvsgvslpdygvswirqppgkglewigviw<br>gsettyyssslksrvtiskdnsknqvslklssvtaadtavyycakhyyyg<br>gsyamdywgqgtlvtvsshhhhhhhh |
| 104879<br>CAR 5-<br>Full-nt | 916 | atggccctccctgtcaccgccctgctgcttccgctggctcttctgctcca<br>cgccgctcggcccgaaattgtgatgacccagtcacccgccactcttagcc<br>tttcaccggtgagcgcgcaaccctgtcttgcagagcctccaagacatc<br>tcaaatacctttaattggtatcaacagaagcccggacaggctcctcgcct<br>tctgatctaccacaccagccggctccattctggaatcccgccaggttca<br>gcggtagcggatctgggaccgactacaccctcactatcagctcactgcag<br>ccagaggacttcgctgtctatttctgtcagcaagggaacaccctgccta<br>caccttggacagggcaccaagctcgagattaaaggtggaggtggcagcg<br>gaggaggtgggtccggcggtggaggaagcggcggaggcgggagccaggtc<br>caactccaagaaagcggaccgggtcttgtgaagccatcagaaactctttc<br>actgacttgtactgtgagcggagtgtctctccccgattacgggtgtctt<br>ggatcagacagccaccgggaaggtctggaatggattggagtgatttgg<br>ggctctgagactacttactactcttcatccctcaagtcacgcgtcaccat<br>ctcaaaggacaactctaagaatcaggtgtcactgaaactgtcatctgtga<br>ccgcagccgacaccgccgtgtactattgcgctaagcattactattatggc<br>gggagctacgcaatggattactggggacagggtactctggtgaccgtgtc<br>cagcaccactacccagcaccgaggccaccaccccggctcctaccatcg<br>cctcccagcctctgtccctgcgtccggaggcatgtagacccgcagctggt<br>ggggccgtgcatacccggggtcttgacttcgcctgcgatatctacatttg<br>ggccctctggctacttgcggggtcctgctgctttcactcgtgatca<br>ctctttactgtaagcgcggtcggaagaagctgctgtacatctttaagcaa<br>cccttcatgaggcctgtgcagactactcaagaggaggacggctgttcatg<br>ccggttcccagaggaggaggaaggcggctgcgaactgcgcgtgaaattca<br>gccgcagcgcagatgctccagcctacaagcaggggcagaaccagctctac<br>aacgaactcaatcttggtcggagagaggagtacgacgtgctggacaagcg |

TABLE 3-continued

CD19 CAR Constructs

| Name | SEQ ID NO: | Sequence |
|---|---|---|
| | | gagaggacgggacccagaaatgggcgggaagccgcgcagaaagaatcccc<br>aagagggcctgtacaacgagctccaaaaggataagatggcagaagcctat<br>agcgagattggtatgaaaggggaacgcagaagaggcaaaggccacgacgg<br>actgtaccagggactcagcaccgccaccaaggacacctatgacgctcttc<br>acatgcaggccctgccgcctcgg |
| 104879 CAR 5- Full-aa | 917 | MALPVTALLLPLALLLHAARPeivmtqspatlslspgeratlscrasqdi skylnwyqqkpgqaprlliyhtsrlhsgiparfsgsgsgtdytltisslq pedfavyfcqqgntlpytfgqgtkleikggggsggggsggggsggggsqv qlqesgpglvkpsetlsltctvsgvslpdygvswirqppgkglewigviw gsettyyssslksrvtiskdnsknqvslklssvtaadtavyycakhyyyg gsyamdywgqgtlvtvssttttpaprppptpaptiasqplslrpeacrpaag gavhtrgldfacdiyiwaplagtcgvlllslvitlyckrgrkkllyifkq pfmrpvqttgeedgcscrfpeeeeggcelrvkfsrsadapaykqgqnqly nelnlgrreeydvldkrrgrdpemggkprrknpqeglynelqkdkmaeay seigmkgerrrgkghdglyqglstatkdtydalhmqalppr |
| | CAR 6 | |
| CAR6 scFv domain | 918 | eivmtqspatlslspgeratlscrasqdiskylnwyqqkpgqaprlliyh tsrlhsgiparfsgsgsgtdytltisslqpedfavyfcqqgntlpytfgq gtkleikggggsggggsggggsggggsqvqlqesgpglvkpsetlsltct vsgvslpdygvswirqppgkglewigviwgsettyyqslksrvtiskdn sknqvslklssvtaadtavyycakhyyyggsyamdywgqgtlvtvss |
| 99790 CAR6- Soluble scFv-nt | 919 | atggccctcccagtgaccgctctgctgctgcctctcgcacttcttctcca tgccgctcggcctgagatcgtcatgacccaaagccccgctaccctgtccc tgtccaccggcgagagggcaacccttcatgcagggccagccaggacatt tctaagtacctcaactggtatcagcagaagcagggcaggctcctcgcct gctgatctaccacaccagccgcctccacagcggtatccccgccagatttt ccgggagcgggtctggaaccgactacaccctcaccatctcttctctgcag cccgaggatttcgccgtctatttctgccagcaggggaatactctgcccgta caccttcggtcaaggtaccaagctggaaatcaagggaggcggaggatcc gcggtggcggaagcggaggaggtggctccggaggaggaggttccaagtg cagcttcaagaatcaggacccggacttgtgaagccatcagaaaccctctc cctgacttgtaccgtgtccggtgtgagcctccccgactacggagtctctt ggattcgccagcctccggggaagggtcttgaatggattgggtgatttgg ggatcagagactacttactaccagtcatcacttaagtcacgggtcaccat cagcaaagataatagcaagaaccaagtgtcacttaagctgtcatctgtga ccgccgctgacaccgccgtgtactattgtgccaaacattactattacgga gggtcttatgctatggactactggggacagggggaccctggtgactgtctc tagccatcaccatcaccaccatcac |
| 99790 CAR6- Soluble scFv-aa | 920 | MALPVTALLLPLALLLHAARPeivmtqspatlslspgeratlscrasqdi skylnwyqqkpgqaprlliyhtsrlhsgiparfsgsgsgtdytltisslq pedfavyfcqqgntlpytfgqgtkleikggggsggggsggggsggggsqv qlqesgpglvkpsetlsltctvsgvslpdygvswirqppgkglewigviw gsettyyqslksrvtiskdnsknqvslklssvtaadtavyycakhyyyg gsyamdywgqgtlvtvsshhhhhhhh |
| 104880 CAR6- Full-nt | 921 | atggccctccctgtcaccgccctgctgcttccgctggctcttctgctcca cgccgctcggcccgaaattgtgatgacccagtcaccgccactcttagcc tttcaccggtgagcgcgcaaccctgtcttgcagagcctccaagacatc tcaaataccttaattggtatcaacagaagcccgacaggctcctcgcct tctgatctaccacaccagccggctccattctggaatccctgccaggttca gcggtagcggatctgggaccgactacaccctcactatcagctcactgcag ccagaggacttcgctgtctatttctgtcagcaaggaacaccctgccta caccttggacagggcaccaagctcgagattaaaggtggaggtggcagcg gaggaggtgggtccggcggtggaggaagcggaggcggagggagccaggtc caactccaagaaagcggaccgggtcttgtgaagccatcagaaactctttc actgacttgtactgtgagcggagtgtctctccccgattacggggtgtctt ggatcagacagccaccggggaagggtctggaatggattggagtgatttgg ggctctgagactacttactaccaatcatccctcaagtcacgcgtcaccat ctcaaaggacaactctaagaatcaggtgtcactgaaactgtcatctgtga ccgcagccgacaccgccgtgtactattgcgctaagcattactattatggc gggagctacgcaatggattactggggacagggtactctggtcaccgtgtc cagcaccactaccccagcaccgaggccacccaccccggctcctaccatcg cctcccagcctctgtccctgcgtccggaggcatgtagacccgcagctggt ggggccgtgcatacccggggtcttgacttcgcctgcgatatctacatttg ggcccctctggctggtacttgcggggtcctgctgctttcactcgtgatca ctcttttactgtaagcgcggtcggaagaagctgctgtacatctttaagcaa cccttcatgaggcctgtgcagactactcaagaggaggacggctgttcatg ccggttcccagaggaggaggaaggcggctgcgaactgcgcgtgaaattca gccgcagcgcagatgctccagcctacaagcaggggcagaaccagctctac aacgaactcaatcttggtcggagagaggagtacgacgtgctggacaagcg |

TABLE 3-continued

CD19 CAR Constructs

| Name | SEQ ID NO: | Sequence |
|---|---|---|
| | | gagaggacgggacccagaaatgggcgggaagccgcgcagaaagaatcccc<br>aagagggcctgtacaacgagctccaaaaggataagatggcagaagcctat<br>agcgagattggtatgaaaggggaacgcagaagaggcaaaggccacgacgg<br>actgtaccagggactcagcaccgccaccaaggacacctatgacgctcttc<br>acatgcaggccctgccgcctcgg |
| 104880<br>CAR6-<br>Full-aa | 922 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsggggsqv<br>qlqesgpglvkpsetlsltctvsgvslpdygvswirqppgkglewigviw<br>gsettyyqsslksrvtiskdnsknqvslklssvtaadtavyycakhyyyg<br>gsyamdywgqgtlvtvssttt paprpptpaptiasqplslrpeacrpaag<br>gavhtrgldfacdiyiwaplagtcgvlllslvitlyckrgrkkllyifkq<br>pfmrpvqttgeedgcscrfpeeeeggcelrvkfsrsadapaykqgqnqly<br>nelnlgrreeydvldkrrgrdpemggkprrknpqeglynelqkdkmaeay<br>seigmkgerrrgkghdglyqglstatkdtydalhmqalppr |

CAR 7

| Name | SEQ ID NO: | Sequence |
|---|---|---|
| CAR7 scFv<br>domain | 923 | qvqlqesgpglvkpsetlsltctvsgvslpdygvswirqppgkglewigv<br>iwgsettyyssslksrvtiskdnsknqvslklssvtaadtavyycakhyy<br>yggsyamdywgqgtlvtvssggggsggggsggggsggggseivmtqspat<br>lslspgeratlscrasqdiskylnwyqqkpgqaprlliyhtsrlhsgipa<br>rfsgsgsgtdytltisslqpedfavyfcqqgntlpytfgqgtkleik |
| 100796<br>CAR7-<br>Soluble<br>scFv-nt | 924 | atggcactgcctgtcactgccctcctgctgcctctggccctccttctgca<br>tgccgccaggccccaagtccagctgcaagagtcaggacccggactggtga<br>agccgtctgagactctctcactgacttgtaccgtcagcggcgtgtccctc<br>cccgactacggagtgtcatggatccgccaacctcccgggaaagggcttga<br>atggattggtgtcatctgggggttctgaaaccacctactactcatcttccc<br>tgaagtccagggtgaccatcagcaaggataattccaagaaccaggtcagc<br>cttaagctgtcatctgtgaccgctgctgacaccgccgtgtattactgcgc<br>caagcactactattacggaggaagctacgctatggactattgggacagg<br>gcactctcgtgactgtgagcagcggcggtggaggtctggaggtggagga<br>tccggtggtggtgggtcaggcggaggagggagcgagattgtgatgactca<br>gtcaccagccacccttctctttcacccggcgagagagcaaccctgagct<br>gtagagccagccaggacatttctaagtacctcaactggtatcagcaaaaa<br>ccggggcaggcccctcgcctcctgatctaccatacctcacgccttcactc<br>tggtatccccgctcggtttagcggatcaggatctggtaccgactacactc<br>tgaccatttccagcctgcagccagaagatttcgcagtgtatttctgccag<br>cagggcaataccccttccttacaccttcggtcagggaaccaagctcgaaat<br>caagcaccatcaccatcatcaccaccat |
| 100796<br>CAR7-<br>Soluble<br>scFv-aa | 925 | MALPVTALLLPLALLLHAARPqvqlqesgpglvkpsetlsltctvsgvsl<br>pdygvswirqppgkglewigviwgsettyyssslksrvtiskdnsknqvs<br>lklssvtaadtavyycakhyyyggsyamdywgqgtlvtvssggggsgggg<br>sggggsggggseivmtqspatlslspgeratlscrasqdiskylnwyqqk<br>pgqaprlliyhtsrlhsgiparfsgsgsgtdytltisslqpedfavyfcq<br>qgntlpytfgqgtkleikhhhhhhhh |
| 104881<br>CAR 7<br>Full-nt | 926 | atggctctgcccgtgaccgcactcctcctgccactggctctgctgcttca<br>cgccgctcgcccacaagtccagcttcaagaatcagggcctggtctggtga<br>agccatctgagactctgtccctcacttgcaccgtgagcggagtgtccctc<br>ccagactacggagtgagctggattagacagcctcccggaaaggg actgga<br>gtggatcggagtgatttggggtagcgaaaccacttactattcatcttccc<br>tgaagtcacgggtcaccatttcaaaggataactcaaagaatcaagtgagc<br>ctcaagtctcatcagtcaccgccgctgacaccgccgtgtattactgtgc<br>caagcattactactatggagggtcctacgccatggactactgggggcagg<br>gaactctggtcactgtgtcatctggtggaggaggtagcggaggaggcggg<br>agcggtggaggtggctccggaggtggcggaagcgaaatcgtgatgaccca<br>gagccctgcaaccctgtcccttctcccggggaacgggctaccctttctt<br>gtcgggcatcacaagatatctcaaaatacctcaattggtatcaacagaag<br>ccgggacaggcccctaggcttcttatctaccacacctctcgcctgcatag<br>cgggattcccgcacgctttagcgggtctggaagcgggaccgactacactc<br>tgaccatctcatctctccagcccgaggacttcgccgtctacttctgccag<br>cagggtaaccctgccgtacaccttcggccagggcaccaagcttgagat<br>caaaaccactactcccgctccaaggccacccacccctgccccgaccatcg<br>cctctcagccgctttccctgcgtccggaggcatgtagacccgcagctggt<br>ggggccgtgcatacccggggtcttgacttcgcctgcgatatctacatttg<br>ggcccctctggctggtacttgcgggggtcctgctgctttcactcgtgatca<br>ctctttactgtaagcgcggtcggaagaagctgctgtacatctttaagcaa<br>cccttcatgaggcctgtgcagactactcaagaggaggacggctgttcatg<br>ccggttcccagaggaggaggaaggcggctgcgaactgcgcgtgaaattca<br>gccgcagcgcagatgctccagcctacaagcaggggcagaaccagctctac<br>aacgaactcaatcttggtcggagagaggagtacgacgtgctggacaagcg |

TABLE 3-continued

CD19 CAR Constructs

| Name | SEQ ID NO: | Sequence |
|---|---|---|
| | | gagaggacgggacccagaaatgggcgggaagccgcgcagaaagaatcccc aagagggcctgtacaacgagctccaaaaggataagatggcagaagcctat agcgagattggtatgaaaggggaacgcagaagaggcaaaggccacgacgg actgtaccagggactcagcaccgccaccaaggacacctatgacgctcttc acatgcaggccctgccgcctcgg |
| 104881 CAR 7 Full-aa | 927 | MALPVTALLLPLALLLHAARPqvqlqesgpglvkpsetlsltctvsgvsl pdygvswirqppgkglewigviwgsettyyssslksrvtiskdnsknqvs lklssvtaadtavyycakhyyyggsyamdywgqgtlvtvssggggsgggg sggggsggggseivmtqspatlslspgeratlscrasqdiskylnwyqqk pgqaprlliyhtsrlhsgiparfsgsgsgtdytltisslqpedfavyfcq qgntlpytfgqgtkleikttttpaprpptpaptiasqplslrpeacrpaag gavhtrgldfacdiyiwaplagtcgvlllslvitlyckrgrkkllyifkq pfmrpvqttgeedgcscrfpeeeeggcelrvkfsrsadapaykqgqnqly nelnlgrreeydvldkrrgrdpemggkprrknpqeglynelqkdkmaeay seigmkgerrrgkghdglyqglstatkdtydalhmqalppr |

CAR 8

| Name | SEQ ID NO: | Sequence |
|---|---|---|
| CAR8 scFv domain | 928 | qvqlqesgpglvkpsetlsltctvsgvslpdygvswirqppgkglewigv iwgsettyyqsslksrvtiskdnsknqvslklssvtaadtavyycakhyy yggsyamdywgqgtlvtvssggggsggggsggggsggggseivmtqspat lslspgeratlscrasqdiskylnwyqqkpgqaprlliyhtsrlhsgipa rfsgsgsgtdytltisslqpedfavyfcqqgntlpytfgqgtkleik |
| 100798 CAR8-Soluble scFv-nt | 929 | atggcactgcctgtcactgccctcctgctgcctctggccctccttctgca tgccgccaggccccaagtccagctgcaagagtcaggaccggactggtga agccgtctgagactctctcactgacttgtaccgtcagcggcgtgtccctc cccgactacggagtgtcatggatccgccaacctcccgggaaagggcttga atggattggtgtcatctggggttctgaaaccacctactaccagtcttccc tgaagtccagggtgaccatcagcaaggataattccaagaaccaggtcagc cttaagctgtcatctgtgaccgctgctgacaccgccgtgtattactgcgc caagcactactattacggaggaagctacgctatggactattgggacagg gcactctcgtgactgtgagcagcggcggtggagggtctggaggtggagga tccggtggtggtgggtcaggcggaggagggagcgagattgtgatgactca gtcaccagccacctttctctttcaccggcgagagagcaacctgagct gtagagccagccaggacatttctaagtacctcaactggtatcagcaaaaa ccggggcaggcccctcgcctcctgatctaccatacctcacgccttcactc tggtatccccgctcggtttagcggatcaggatctggtaccgactacactc tgaccatttccagcctgcagccagaagatttcgcagtgtatttctgccag cagggcaatacccttccttacaccttcggtcagggaaccaagctcgaaat caagcaccatcaccatcatcaccac |
| 100798 CAR8-Soluble scFv-aa | 930 | MALPVTALLLPLALLLHAARPqvqlqesgpglvkpsetlsltctvsgvsl pdygvswirqppgkglewigviwgsettyyqsslksrvtiskdnsknqvs lklssvtaadtavyycakhyyyggsyamdywgqgtlvtvssggggsgggg sggggsggggseivmtqspatlslspgeratlscrasqdiskylnwyqqk pgqaprlliyhtsrlhsgiparfsgsgsgtdytltisslqpedfavyfcq qgntlpytfgqgtkleikhhhhhhhh |
| 104882 CAR 8-Full-nt | 931 | atggctctgcccgtgaccgcactcctcctgccactggctctgctgcttca cgccgctcgcccacaagtccagcttcaagaatcagggcctggtctggtga agccatctgagactctgtccctcacttgcaccgtgagcggagtgtccctc ccagactacggagtgagctggattagacagcctcccggaaaggggactgga gtggatcggagtgatttggggtagcgaaaccacttactatcaatcttccc tgaagtcacgggtcaccattcaaggataactcaaagaatcaagtgagc ctcaagtctcatcagtcaccgccgctgacaccgccgtgtattactgtgc caagcattactactatggagggtcctacgccatggactactgggggcagg gaactctggtcactgtgtcatctggtggaggaggtagcggaggaggcggg agcggtggaggtggctccggaggcggtgggtcagaaatcgtgatgaccca gagccctgcaaccctgtcccttctcccggggaacgggctacccttctt gtcgggcatcacaagatatctcaaaatacctcaattggtatcaacagaag ccgggacaggcccctaggcttcttatctaccacacctctcgcctgcatag cgggattcccgcacgctttagcgggtctggaagcgggaccgactacactc tgaccatctcatctctccagcccgaggacttcgccgtctacttctgccag cagggtaaccctgccgtacaccttcggccaggggcaccaagcttgagat caaaaccactactcccgctccaaggccacccacccctgccccgaccatcg cctctcagccgctttccctgctccggaggcatgtagacccgcagctggt ggggccgtgcataccggggtcttgacttcgcctgcgatatctacatttg ggcccctctggctggtacttgcggggtcctgctgctttcactcgtgatca ctctttactgtaagcgcggtcggaagaagctgctgtacatctttaagcaa cccttcatgaggcctgtgcagactactcaagaggaggacggctgttcatg ccggttcccagaggaggaggaaggcggctgcgaactgcgcgtgaaattca gccgcagcgcagatgctccagcctacaagcaggggcagaaccagctctac aacgaactcaatcttggtcggagagaggagtacgacgtgctggacaagcg |

TABLE 3-continued

CD19 CAR Constructs

| Name | SEQ ID NO: | Sequence |
|---|---|---|
| | | gagaggacgggacccagaaatgggcgggaagccgcgcagaaagaatcccc<br>aagagggcctgtacaacgagctccaaaaggataagatggcagaagcctat<br>agcgagattggtatgaaaggggaacgcagaagaggcaaaggccacgacgg<br>actgtaccagggactcagcaccgccaccaaggacacctatgacgctcttc<br>acatgcaggccctgccgcctcgg |
| 104882<br>CAR 8-<br>Full-aa | 932 | MALPVTALLLPLALLLHAARPqvqlqesgpglvkpsetlsltctvsgvsl<br>pdygvswirqppgkglewigviwgsettyyqsslksrvtiskdnsknqvs<br>lklssvtaadtavyycakhyyyggsyamdywgqgtlvtvssggggsgggg<br>sggggsggggseivmtqspatlslspgeratlscrasqdiskylnwyqqk<br>pgqaprlliyhtsrlhsgiparfsgsgsgtdytltisslqpedfavyfcq<br>qgntlpytfgqgtkleiktttpaprpptpaptiasqplslrpeacrpaag<br>gavhtrgldfacdiyiwaplagtcgvlllslvitlyckrgrkkllyifkq<br>pfmrpvqttgeedgcscrfpeeeeggcelrvkfsrsadapaykqggnqly<br>nelnlgrreeydvldkrrgrdpemggkprrknpqeglynelqkdkmaeay<br>seigmkgerrrgkghdglyqglstatkdtydalhmqalppr |

CAR 9

| CAR9 scFv<br>domain | 933 | eivmtqspatlslspgeratlscrasqdiskylnwyqqkpgqaprlliyh<br>tsrlhsgiparfsgsgsgtdytltisslqpedfavyfcqqgntlpytfgq<br>gtkleikggggsggggsggggsggggsqvqlqesgpglvkpsetlsltct<br>vsgvslpdygvswirqppgkglewigviwgsettyynsslksrvtiskdn<br>sknqvslklssvtaadtavyycakhyyyggsyamdywgqgtlvtvss |
| 99789<br>CAR9-<br>Soluble<br>scFv-nt | 934 | atggccctcccagtgaccgctctgctgctgcctctcgcacttcttctcca<br>tgccgctcggcctgagatcgtcatgacccaaagccccgctacccctgtcc<br>tgtcaccggcgagagggcaaccctttcatgcagggccagccaggacatt<br>tctaagtacctcaactggtatcagcagaagcagggcaggctcctcgcct<br>gctgatctaccacaccagccgcctccacagcggtatccccgccagatttt<br>ccgggagcgggtctggaaccgactacaccctcaccatctcttctctgcag<br>cccgaggatttcgccgtctatttctgccagcaggggaatactctgccgta<br>caccttcggtcaaggtaccaagctggaaatcaagggaggcggaggatcag<br>gcggtggcggaagcggaggaggtggctccggaggaggaggttccaagtg<br>cagcttcaagaatcaggacccggacttgtgaagccatcagaaaccctctc<br>cctgacttgtaccgtgtccggtgtgagcctccccgactacggagtctctt<br>ggattcgccagcctccggggaagggtcttgaatggattgggtgatttgg<br>ggatcagagactacttactacaattcatcacttaagtcacgggtcaccat<br>cagcaaagataatagcaagaaccaagtgtcacttaagctgtcatctgtga<br>ccgccgctgacaccgccgtgtactattgtgccaaacattactattacgga<br>gggtcttatgctatggactactggggacagggacccctggtgactgtctc<br>tagccatcaccatcaccaccatcac |
| 99789<br>CAR9-<br>Soluble<br>scFv-aa | 935 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsggggsqv<br>qlqesgpglvkpsetlsltctvsgvslpdygvswirqppgkglewigviw<br>gsettyynsslksrvtiskdnsknqvslklssvtaadtavyycakhyyyg<br>gsyamdywgqgtlvtvsshhhhhhhh |
| 105974<br>CAR 9-<br>Full-nt | 936 | atggccctccctgtcaccgccctgctgcttccgctggctcttctgctcca<br>cgccgctcggcccgaaattgtgatgacccagtcacccgccactcttagcc<br>tttcaccggtgagcgcgcaaccctgtcttgcagagcctccaagacatc<br>tcaaatacccttaattggtatcaacagaagcccggacaggctcctcgcct<br>tctgatctaccacaccagccggctccattctggaatccctgccaggttca<br>gcggtagcggatctgggaccgactacaccctcactatcagctcactgcag<br>ccagaggacttcgctgtctatttctgtcagcaagggaacaccctgccta<br>caccttggacagggcaccaagctcgagattaaaggtggaggtggcagcg<br>gaggaggtgggtccggcggtggaggaagcggaggcggtgggagccaggtc<br>caactccaagaaagcggaccgggtcttgtgaagccatcagaaactctttc<br>actgacttgtactgtgagcggagtgtctctccccgattacggggtgtctt<br>ggatcagacagccaccggggaagggtctggaatggattggagtgatttgg<br>ggctctgagactacttactacaactcatccctcaagtcacgcgtcaccat<br>ctcaaaggacaactctaagaatcaggtgtcactgaaactgtcatctgtga<br>ccgcagccgacaccgccgtgtactattgcgctaagcattactattatggc<br>gggagctacgcaatggattactggggacagggtactctggtcaccgtgtc<br>cagcaccactaccccagcaccgaggccacccaccccggctcctaccatcg<br>cctcccagcctctgtccctgcgtccggaggcatgtagacccgcagctggt<br>ggggccgtgcatacccggggtcttgacttcgcctgcgatatctacatttg<br>ggcccctctggctacttggggtcctgctgctttcactcgtgatca<br>ctctttactgtaagcgcggtcggaagaagctgctgtacatctttaagcaa<br>cccttcatgagggcctgtgcagactactcaagaggaggacggctgttcatg<br>ccggttcccagaggaggaggaaggcggctgcgaactcgcgtgaaattca<br>gccgcagcgcagatgctccagcctacaagcaggggcagaaccagctctac<br>aacgaactcaatcttggtcggagagaggagtacgacgtgctggacaagcg |

TABLE 3-continued

CD19 CAR Constructs

| Name | SEQ ID NO: | Sequence |
| --- | --- | --- |
| | | gagaggacgggacccagaaatgggcgggaagccgcgcagaaagaatcccc<br>aagagggcctgtacaacgagctccaaaaggataagatggcagaagcctat<br>agcgagattggtatgaaaggggaacgcagaagaggcaaaggccacgacgg<br>actgtaccagggactcagcaccgccaccaaggacacctatgacgctcttc<br>acatgcaggccctgccgcctcgg |
| 105974<br>CAR 9-<br>Full-aa | 937 | MALPVTALLLPLALLLHAARPeivmtqspatlslspgeratlscrasqdi<br>skylnwyqqkpgqaprlliyhtsrlhsgiparfsgsgsgtdytltisslq<br>pedfavyfcqqgntlpytfgqgtkleikggggsggggsggggsggggsqv<br>qlqesgpglvkpsetlsltctvsgvslpdygvswirqppgkglewigviw<br>gsettyynsslksrvtiskdnsknqvslklssvtaadtavyycakhyyyg<br>gsyamdywgqgtlvtvsstttpaprpptpaptiasqplslrpeacrpaag<br>gavhtrgldfacdiyiwaplagtcgvlllslvitlyckrgrkkllyifkq<br>pfmrpvqttgeedgcscrfpeeeeggcelrvkfsrsadapaykqggnqly<br>nelnlgrreeydvldkrrgrdpemggkprrknpqeglynelqkdkmaeay<br>seigmkgerrrgkghdglyqglstatkdtydalhmqalppr |
| | | CAR10 |
| CAR10<br>scFv<br>domain | 938 | qvqlqesgpglvkpsetlsltctvsgvslpdygvswirqppgkglewigv<br>iwgsettyynsslksrvtiskdnsknqvslklssvtaadtavyycakhyy<br>yggsyamdywgqgtlvtvssggggsggggsggggsggggseivmtqspat<br>lslspgeratlscrasqdiskylnwyqqkpgqaprlliyhtsrlhsgipa<br>rfsgsgsgtdytltisslqpedfavyfcqqgntlpytfgqgtkleik |
| 100796<br>CAR10-<br>Soluble<br>scFv-nt | 939 | atggcactgcctgtcactgccctcctgctgcctctggccctccttctgca<br>tgccgccaggccccaagtccagctgcaagagtcaggacccggactggtga<br>agccgtctgagactctctcactgacttgtaccgtcagcggcgtgtccctc<br>cccgactacggagtgtcatggatccgccaacctcccgggaaagggcttga<br>atggattggtgtcatctggggttctgaaaccacctactacaactcttccc<br>tgaagtccagggtgaccatcagcaaggataattccaagaaccaggtcagc<br>cttaagctgtcatctgtgaccgctgctgacaccgccgtgtattactgcgc<br>caagcactactattacggaggaagctacgctatggactattgggacagg<br>gcactctcgtgactgtgagcagcggcggtggaggtctggaggtggagga<br>tccggtggtggtgggtcaggcggaggaggcgagattgtgatgactca<br>gtcaccagccaccctttctctttcacccggcgagagagcaacctgagct<br>gtagagccagccaggacatttctaagtacctcaactggtatcagcaaaaa<br>ccggggcaggcccctcgcctcctgatctaccatacctcacgccttcactc<br>tggtatcccgctcggtttagcggatcaggatctggtaccgactacactc<br>tgaccatttccagcctgcagccagaagatttcgcagtgtatttctgccag<br>cagggcaataccccttccttacaccttcggtcagggaaccaagctcgaaat<br>caagcaccatcaccatcatcaccaccat |
| 100796<br>CAR10-<br>Soluble<br>scFv-aa | 940 | MALPVTALLLPLALLLHAARPqvqlqesgpglvkpsetlsltctvsgvsl<br>pdygvswirqppgkglewigviwgsettyynsslksrvtiskdnsknqvs<br>lklssvtaadtavyycakhyyyggsyamdywgqgtlvtvssggggsgggg<br>sggggsggggseivmtqspatlslspgeratlscrasqdiskylnwyqqk<br>pgqaprlliyhtsrlhsgiparfsgsgsgtdytltisslqpedfavyfcq<br>qgntlpytfgqgtkleikhhhhhhhh |
| 105975<br>CAR 10<br>Full-nt | 941 | atggccctcctgtcaccgccctgctgcttccgctggctcttctgctcca<br>cgccgctcggcccgaaattgtgatgacccagtcacccgccactcttagcc<br>tttcacccggtgagcgcgcaaccctgtcttgcagagcctccaagacatc<br>tcaaaataccttaattggtatcaacagaagcccgacaggctcctcgcct<br>tctgatctaccacaccagccggctccattctggaatcccgccaggttca<br>gcggtagcgatctgggaccgactacaccctcactatcagctcactgcag<br>ccagaggacttcgctgtctatttctgtcagcaagggaacaccctgcccta<br>caccctttggacagggcaccaagctcgagattaaaggtggaggtggcagcg<br>gaggaggtgggtccggcggtggaggaagcggaggcggtgggagccaggtc<br>caactccaagaaagcggaccgggtcttgtgaagccatcagaaactctttc<br>actgacttgtactgtgagcggagtgtctctccccgattacggggtgtctt<br>ggatcagacagccaccggggaagggtctggaatggattggagtgatttgg<br>ggctctgagactacttactacaactcatccctcaagtcacgcgtcaccat<br>ctcaaaggacaactctaagaatcaggtgtcactgaaactgtcatctgtga<br>ccgcagccgacaccgccgtgtactattgcgctaagcattactattatggc<br>gggagctacgcaatggattactggggacagggtactctggtcaccgtgtc<br>cagcaccactaccccagcaccgaggccacccaccccggctcctaccatcg<br>cctcccagcctctgtccctgcgtccggaggcatgtagacccgcagctggt<br>ggggccgtgcatacccggggtcttgacttcgcctgcgatatctacatttg<br>ggcccctctggctacttgcggggtcctgctgcttcactcgtgatca<br>ctcttttactgtaagcgcggtcggaagaagctgctgttacatctttaagcaa<br>cccttcatgaggcctgtgcagactactcaagaggaggacggctgttcatg<br>ccggttcccagaggaggaggaaggcggctgcgaactgcgcgtgaaattca<br>gccgcagcgcagatgctccagcctacaagcaggggcagaaccagctctac<br>aacgaactcaatcttggtcggagagaggagtacgacgtgctggacaagcg |

TABLE 3-continued

CD19 CAR Constructs

| Name | SEQ ID NO: | Sequence |
|---|---|---|
| | | gagaggacgggacccagaaatgggcgggaagccgcgcagaaagaatcccc aagagggcctgtacaacgagctccaaaaggataagatggcagaagcctat agcgagattggtatgaaaggggaacgcagaagaggcaaaggccacgacgg actgtaccagggactcagcaccgccaccaaggacacctatgacgctcttc acatgcaggccctgccgcctcgg |
| 105975 CAR 10 Full-aa | 942 | MALPVTALLLPLALLLHAARPEIVMTQSPATLSLSPGERATLSCRASQDI SKYLNWYQQKPGQAPRLLIYHTSRLHSGIPARFSGSGSGTDYTLTISSLQ PEDFAVYFCQQGNTLPYTFGQGTKLEIKGGGGSGGGGSGGGGSGGGGSQV QLQESGPGLVKPSETLSLTCTVSGVSLPDYGVSWIRQPPGKGLEWIGVIW GSETTYYNSSLKSRVTISKDNSKNQVSLKLSSVTAADTAVYYCAKHYYYG GSYAMDYWGQGTLVTVSSTTTPAPRPPTPAPTIASQPLSLRPEACRPAAG GAVHTRGLDFACDIYIWAPLAGTCGVLLLSLVITLYCKRGRKKLLYIFKQ PFMRPVQTTQEEDGCSCRFPEEEEGGCELRVKFSRSADAPAYKQGQNQLY NELNLGRREEYDVLDKRRGRDPEMGGKPRRKNPQEGLYNELQKDKMAEAY SEIGMKGERRRGKGHDGLYQGLSTATKDTYDALHMQALPPR |

CAR11

| CAR11 scFv domain | 943 | eivmtqspatlslspgeratlscrasqdiskylnwyqqkpgqaprlliyh tsrlhsgiparfsgsgsgtdytltisslqpedfavyfcqqgntlpytfgq gtkleikggggsggggsggggsqvqlqesgpglvkpsetlsltctvsgvs lpdygvswirqppgkglewigviwgsettyynsslksrvtiskdnsknqv slklssvtaadtavyycakhyyyggsyamdywgqgtlvtvss |
| 103101 CAR11- Soluble scFv-nt | 944 | Atggccctccctgtcaccgccctgctgcttccgctggctcttctgctcca cgccgctcggcccgaaattgtgatgacccagtcaccgccactcttagcc tttcaccccggtgagcgcgcaaccctgtcttgcagagcctccaagacatc tcaaaatacccttaattggtatcaacagaagcccgacaggctcctcgcct tctgatctaccacaccagccggctccattctggaatcccgccaggttca gcggtagcggatctgggaccgactacaccctcactatcagctcactgcag ccagaggacttcgctgtctatttctgtcagcaagggaacaccctgccccta cacctttggacagggcaccaagctcgagattaaaggtggaggtggcagcg gaggaggtgggtccggcggtggaggaagccaggtccaactccaagaaagc ggaccgggtcttgtgaagccatcagaaactctttcactgacttgtactgt gagcggagtgtctctccccgattacggggtgtcttggatcagacagccac cggggaagggtctgaatggattggagtgatttggggctctgagactact tactacaattcatccctcaagtcacgcgtcaccatctcaaaggacaactc taagaatcaggtgtcactgaaactgtcatctgtgaccgcagccgacaccg ccgtgtactattgcgctaagcattactattatggcgggagctacgcaatg gattactggggacagggtactctggtcaccgtgtccagccaccaccatca tcaccatcaccat |
| 103101 CAR11- Soluble scFv-aa | 945 | MALPVTALLLPLALLLHAARPeivmtqspatlslspgeratlscrasqdi skylnwyqqkpgqaprlliyhtsrlhsgiparfsgsgsgtdytltisslq pedfavyfcqqgntlpytfgqgtkleikggggsggggsggggsqvqlqes gpglvkpsetlsltctvsgvslpdygvswirqppgkglewigviwgsett yynsslksrvtiskdnsknqvslklssvtaadtavyycakhyyyggsyam dywgqgtlvtvsshhhhhhhh |
| 105976 CAR 11 Full-nt | 946 | atggctctgcccgtgaccgcactcctcctgccactggctctgctgcttca cgccgctcgcccacaagtccagcttcaagaatcagggcctggtctggtga agccatctgagactctgtccctcacttgcaccgtgagcggagtgtccctc ccagactacggagtgagctggattagacagcctcccgaaaggactaga gtggatcggagtgatttggggtagcgaaaccacttactataactcttccc tgaagtcacgggtcaccatttcaaaggataactcaaagaatcaagtgagc ctcaagtctctcatcagtcaccgccgctgacaccgccgtgtattactgtgc caagcattactactatggagggtcctacgccatggactactggggccagg gaactctggtcactgtgtcatctggtggaggaggtagcggaggaggcggg agcggtggaggtggctccggaggtggcggaagcgaaatcgtgatgaccca gagccctgcaaccctgtcccttctcccggggaacgggctacccttttctt gtcgggcatcacaagatatctcaaaatacctcaattggtatcaacagaag ccgggacaggccctaggcttcttatctaccacacctctcgcctgcatag cgggattcccgcacgctttagcgggtctggaagcggaccgactacactc tgaccatctcatctctccagcccgaggacttcgcgtctacttctgccag cagggtaacacctgccgtacaccttcggccagggcaccaagcttgagat caaaaccactactccgctccaaggcacccacccctgccccgaccatcg cctctcagccgctttccctgctccggaggcatgtagacccgcagctggt ggggccgtgcatacccggggtcttgacttcgcctgcgatatctacatttg ggcccctctggctggtacttgcggggtcctgctgcttcactcgtgatca ctctttactgtaagcgcggtcggaagaagctgctgtacatctttaagcaa ccctcatgaggcctgtgcagactactcaagaggaggacggctgttcatg ccggttcccagaggaggaggaaggcggctgcgaactgcgcgtgaaattca gccgcagcgcagatgctccagcctacaagcagggggcagaaccagctctac aacgaactcaatcttggtcggagagaggagtacgacgtgctggacaagc |

TABLE 3-continued

CD19 CAR Constructs

| Name | SEQ ID NO: | Sequence |
|---|---|---|
| | | gagaggacgggacccagaaatgggcgggaagccgcgcagaaagaatcccc aagagggcctgtacaacgagctccaaaaggataagatggcagaagcctat agcgagattggtatgaaaggggaacgcagaagaggcaaaggccacgacgg actgtaccagggactcagcaccgccaccaaggacacctatgacgctcttc acatgcaggccctgccgcctcgg |
| 105976 CAR 11 Full-aa | 947 | MALPVTALLLPLALLLHAARPQVQLQESGPGLVKPSETLSLTCTVSGVSL PDYGVSWIRQPPGKGLEWIGVIWGSETTYYNSSLKSRVTISKDNSKNQVS LKLSSVTAADTAVYYCAKHYYYGGSYAMDYWGQGTLVTVSSGGGGSGGGG SGGGGSGGGGSEIVMTQSPATLSLSPGERATLSCRASQDISKYLNWYQQK PGQAPRLLIYHTSRLHSGIPARFSGSGSGTDYTLTISSLQPEDFAVYFCQ QGNTLPYTFGQGTKLEIKTTTPAPRPPTPAPTIASQPLSLRPEACRPAAG GAVHTRGLDFACDIYIWAPLAGTCGVLLLSLVITLYCKRGRKKLLYIFKQ PFMRPVQTTQEEDGCSCRFPEEEEGGCELRVKFSRSADAPAYKQGQNQLY NELNLGRREEYDVLDKRRGRDPEMGGKPRRKNPQEGLYNELQKDKMAEAY SEIGMKGERRRGKGHDGLYQGLSTATKDTYDALHMQALPPR |
| | | CAR12 |
| CAR12 scFv domain | 948 | qvqlqesgpglvkpsetlsltctvsgvslpdygvswirqppgkglewigv iwgsettyynsslksrvtiskdnsknqvslklssvtaadtavyycakhyy yggsyamdywgqgtlvtvssggggsggggsggggseivmtqspatlslsp geratlscrasqdiskylnwyqqkpgqaprlliyhtsrlhsgiparfsgs gsgtdytltisslqpedfavyfcqqgntlpytfgqgtkleik |
| 103104 CAR12-Soluble scFv-nt | 949 | atggctctgccgtgaccgcactcctcctgccactggctctgctgcttca cgccgctcgcccacaagtccagcttcaagaatcagggcctggtctggtga agccatctgagactctgtccctcacttgcaccgtgagcggagtgtcctc ccagactacggagtgagctggattagacagcctcccggaaagggactgga gtggatcggagtgatttggggtagcgaaaccacttactataactcttccc tgaagtcacgggtcaccatttcaaaggataactcaaagaatcaagtgagc ctcaagctctcatcagtcaccgccgctgacaccgccgtgtattactgtgc caagcattactactatggagggtcctacgccatggactactggggccagg gaactctggtcactgtgtcatctggtggaggaggtagcggaggaggcggg agcggtggaggtggctccgaaatcgtgatgacccagagccctgcaaccct gtccctttctccggggaacggctacccctttcttgtcgggcatcacaag atatctcaaaatacctcaattggtatcaacagaagccgggacaggcccct aggcttcttatctaccacacctctcgcctgcatagcgggattcccgcacg ctttagcgggtctggaagcgggaccgactacactctgaccatctcatctc tccagcccgaggacttcgccgtctacttctgccagcagggtaacaccctg ccgtacaccttcggccagggcaccaagcttgagatcaaacatcaccacca tcatcaccatcac |
| 103104 CAR12-Soluble scFv-aa | 950 | MALPVTALLLPLALLLHAARPqvqlqesgpglvkpsetlsltctvsgvsl pdygvswirqppgkglewigviwgsettyynsslksrvtiskdnsknqvs lklssvtaadtavyycakhyyyggsyamdywgqgtlvtvssggggsgggg sggggseivmtqspatlslspgeratlscrasqdiskylnwyqqkpgqap rlliyhtsrlhsgiparfsgsgsgtdytltisslqpedfavyfcqqgntl pytfgqgtkleikhhhhhhhh |
| 105977 CAR 12-Full-nt | 951 | atggccctccctgtcaccgccctgctgcttccgctggctcttctgctcca cgccgctcggcccgaaattgtgatgacccagtcacccgccactcttagcc tttcaccccggtgagcgcgcaaccctgtcttgcagagcctccaagacatc tcaaaataccttaattggtatcaacagaagcccggacaggctcctcgcct tctgatctaccacaccagccggctccattctggaatcccgtgccaggttca gcggtagcggatctgggaccgactacaccctcactatcagctcactgcag ccagaggacttcgctgtctatttctgtcagcaagggaacaccctgcccta caccttggacagggcaccaagctcgagattaaaggtggaggtggcagcg gaggaggtgggtccggcggtggaggaagccaggtccaactccaagaaagc ggaccgggtcttgtgaagcctcagaaactctttcactgacttgtactgt gagcggagtgtctctccccgattacggggtgtcttggatcagacagccac cggggaagggtctggaatggattgagtgatttgggctctgagactact tactacaactcatccctcaagtcacgcgtcaccatctcaaaggacaactc taagaatcaggtgtcactgaaactgtcatctgtgaccgcagccgacaccg ccgtgtactattgcgctaagcattactattatggcggagctacgcaatg gattactggggacagggtactctggtcaccgtgtccagcaccactacccc agcaccgaggccacccaccccggctcctaccatcgcctcccagcctctgt ccctgcgtccggaggcatgtagacccgcagctggtggggccgtgcatacc cggggtcttgacttcgcctgcgatatctacatttgggcccctctggctgg tacttgcggggtcctgctgcttcactcgtgatcactcttactgtaagc gcggtcggaagaagctgctgtacatctttaagcaaccccttcatgaggcct gtgcagactactcaagaggaggacggctgttcatgccggttcccagagga ggaggaaggcggctgcgaactgcgcgtgaaattcagccgcagcgcagatg ctccagcctacaagcaggggcagaaccagctctcaaacgaactcaatctt ggtcggagagaggagtacgacgtgctggacaagcggagaggacgggaccc |

TABLE 3-continued

CD19 CAR Constructs

| Name | SEQ ID NO: | Sequence |
|---|---|---|
| | | agaaatgggcgggaagccgcgcagaaagaatcccccaagagggcctgtaca acgagctccaaaaggataagatggcagaagcctatagcgagattggtatg aaaggggaacgcagaagaggcaaaggccacgacggactgtaccagggact cagcaccgccaccaaggacacctatgacgctcttcacatgcaggccctgc cgcctcgg |
| 105977 CAR 12-Full-aa | 952 | MALPVTALLLPLALLLHAARPEIVMTQSPATLSLSPGERATLSCRASQDI SKYLNWYQQKPGQAPRLLIYHTSRLHSGIPARFSGSGSGTDYTLTISSLQ PEDFAVYFCQQGNTLPYTFGQGTKLEIKGGGGSGGGGSGGGGSQVQLQES GPGLVKPSETLSLTCTVSGVSLPDYGVSWIRQPPGKGLEWIGVIWGSETT YYNSSLKSRVTISKDNSKNQVSLKLSSVTAADTAVYYCAKHYYYGGSYAM DYWGQGTLVTVSSTTTPAPRPPTPAPTIASQPLSLRPEACRPAAGGAVHT RGLDFACDIYIWAPLAGTCGVLLLSLVITLYCKRGRKKLLYIFKQPFMRP VQTTQEEDGCSCRFPEEEEGGCELRVKFSRSADAPAYKQGQNQLYNELNL GRREEYDVLDKRRGRDPEMGGKPRRKNPQEGLYNELQKDKMAEAYSEIGM KGERRRGKGHDGLYQGLSTATKDTYDALHMQALPPR |

CTL019

| Name | SEQ ID NO: | Sequence |
|---|---|---|
| CTL019-Soluble scFv-Histag-nt | 953 | atggccctgccccgtcaccgctctgctgctgccccttgctctgcttcttca tgcagcaaggccggacatccagatgacccaaaccacctcatccctctctg cctctcttggagacagggtgaccatttcttgtcgcgccagccaggacatc agcaagtatctgaactggtatcagcagaagccggacggaaccgtgaagct cctgatctaccatacctctcgcctgcatagcggcgtgccctcacgcttct ctggaagcggatcaggaagcggatcaggaaccgattattctctcactattttcaaatcttgag caggaagatattgccacctatttctgccagcagggtaataccctgccccta caccttcggaggagggaccaagctcgaaatcaccggtggaggaggcagcg gcggtggagggtctggtggaggtggttctgaggtgaagctgcaagaatca ggccctggacttgtggccccttcacagtccctgagcgtgacttgcaccgt gtccggagtctccctgcccgactacggagtgtcatggatcagacaacctc cacgaaaggactggaatggctcggtgtcatctggggtagcgaaactact tactacaattcagccctcaaaagcaggctgactattatcaaggacaacag caagtcccaagtctttcttaagatgaactcactccagactgacgacaccg caatctactattgtgctaagcactactactacggaggatcctacgctatg gattactggggacaaggtacttccgtcactgtctcttcacaccatcatca ccatcaccatcac |
| CTL019-Soluble scFv-Histag-aa | 954 | MALPVTALLLPLALLLHAARPdiqmtqttsslsaslgdrvtiscrasqdi skylnwyqqkpdgtvkllyyhtsrlhsgvpsrfsgsgsgtdysltisnle qediatyfcqqgntlpytfgggtkleitggggsggggsggggsevklqes gplvapsqslsvtctvsgvslpdygvswirqpprkglewlgviwgsett yynsalksrltiikdnsksqvflkmnslqtddtaiyycakhyyyggsyam dywgqgtsvtvsshhhhhhhh |
| CTL019 Full-nt | 955 | atggccttaccagtgaccgccttgctcctgccgctggccttgctgctcca cgccgccaggccggacatccagatgacacagactacatcctcccctgtctg cctctcttgggagacagagtcaccatcagttgcagggcaagtcaggacatt agtaaatatttaaattggtatcagcagaaaccagatggaactgttaaact cctgatctaccatacatcaagattacactcaggagtcccatcaaggttca gtggcagtgggtctggaacagattattctctcaccattagcaacctggag caagaagatattgccacttactttgccaacagggtaatacgcttccgta cacgttcggaggggggaccaagctggagatcacaggtggcggtggctcgg gcggtggtgggctcggtggcggcggatctgaggtgaaactgcaggagtca ggacctggcctggtggcgccctcacagagcctgtccgtcacatgcactgt ctcagggtctcattacccgactatggtgtaagctggattcgccagcctc cacgaaagggtctggagtggctgggagtaatatgggtagtgaaaccaca tactataattcagctctcaaatccagactgaccatcatcaaggacaactc caagagccaagtttttcttaaaaatgaacagtctgcaaactgatgacacag ccatttactactgtgccaaacattattactacggtggtagctatgctatg gactactggggccaaggaacctcagtcaccgtctcctcaaccacgacgcc agcgccgcgaccaccaacaccggcgcccaccatcgcgtcgcagcccctgt cccctgcgcccagaggcgtgccggcagcggcggggggcgcagtgcacacg aggggggctggacttcgcctgtgatatctacatctgggcgcccttggccgg gacttgtgggtccttctcctgtcactggtttatcaccctttactgcaaac ggggcagaaagaaactcctgtatatattcaaacaaccatttatgagacca gtacaaactactcaagaggaagatggctgtagctgccgatttccagaaga agaagaaggaggatgtgaactgagagtgaagttcagcaggagcgcagacg ccccccgcgtacaagcagggccagaaccagctctataacgagctcaatcta ggacgaagagaggagtacgatgtttttggacaagacgtggccgggaccc tgagatgggggaaagccgagaaggaagaaccctcaggaaggcctgtaca atgaactgcagaaaagataagatggcggaggcctacagtgagattggaatg aaaggcgagcgccggagggggcaaggggcacgatggcctttaccagggtct cagtacagccaccaaggacacctacgacgcccttcacatgcaggccctgc cccctcgc |

TABLE 3-continued

| CD19 CAR Constructs | | |
|---|---|---|
| Name | SEQ ID NO: | Sequence |
| CTL019 Full-aa | 956 | MALPVTALLLPLALLLHAARPdiqmtqttsslsaslgdrvtiscrasqdi skylnwyqqkpdgtvklliyhtsrlhsgvpsrfsgsgsgtdysltisnle qediatyfcqqgntlpytfgggtkleitggggsggggsggggsevklqes gpglvapsqslsvtctvsgvslpdygvswirqpprkglewlgviwgsett yynsalksrltiikdnsksqvflkmnslqtddtaiyycakhyyyggsyam dywgqgtsvtvssttttpaprpptpaptiasqplslrpeacrpaaggavht rgldfacdiyiwaplagtcgvlllslvitlyckrgrkkllyifkqpfmrp vqttgeedgcscrfpeeeeggcelrvkfsrsadapaykqgqnqlynelnl grrreeydvldkrrgrdpemggkprrknpqeglynelqkdkmaeayseigm kgerrrgkghdglyqglstatkdtydalhmqalppr |
| CTL019 scFv domain | 957 | diqmtqttsslsaslgdrvtiscrasqdiskylnwyqqkpdgtvklliyh tsrlhsgvpsrfsgsgsgtdysltisnleqediatyfcqqgntlpytfgg gtkleitggggsggggsggggsevklqesgpglvapsqslsvtctvsgvs lpdygvswirqpprkglewlgviwgsettyynsalksrltiikdnsksqv flkmnslqtddtaiyycakhyyyggsyamdywgqgtsvtvss |
| mCAR1 scFv | 417 | QVQLLESGAELVRPGSSVKISCKASGYAFSSYWMNWVKQRPGQGLEWIGQ IYPGDGDTNYNGKFKGQATLTADKSSTAYMQLSGLTSEDSAVYSCARKT ISSVVDFYFDYWGQGTTVTGGGSGGGSGGGSGGGSELVLTQSPKFMSTSV GDRVSVTCKASQNVGTNVAWYQQKPGQSPKPLIYSATYRNSGVPDRFTGS GSGTDFTLTITNVQSKDLADYFCQYNRYPYTSFFFTKLEIKRRS |
| mCAR1 Full-aa | 1938 | QVQLLESGAELVRPGSSVKISCKASGYAFSSYWMNWVKQRPGQGLEWIGQ IYPGDGDTNYNGKFKGQATLTADKSSTAYMQLSGLTSEDSAVYSCARKT ISSVVDFYFDYWGQGTTVTGGGSGGGSGGGSGGGSELVLTQSPKFMSTSV GDRVSVTCKASQNVGTNVAWYQQKPGQSPKPLIYSATYRNSGVPDRFTGS GSGTDFTLTITNVQSKDLADYFCQYNRYPYTSFFFTKLEIKRRSKIEVMY PPPYLDNEKSNGTIIHVKGKHLCPSPLFPGPSKPFWVLVVVGGVLACYSL LVTVAFIIFWVRSKRSRLLHSDYMNMTPRRPGPTRKHYQPYAPPRDFAAY RSRVKFSRSADAPAYQQGQNQLYNELNLGRREEYDVLDKRRGRDPEMGGK PRRKNPQEGLYNELQKDKMAEAYSEIGMKGERRRGKGHDGLYQGLSTATK DTYDALHMQALPPR |
| mCAR2 scFv | 423 | DIQMTQTTSSLSASLGDRVTISCRASQDISKYLNWYQQKPDGTVKLLIYH TSRLHSGVPSRFSGSGSGTDYSLTISNLEQEDIATYFCQQGNTLPYTFGG GTKLEITGSTSGSGKPGSGEGSTKGEVKLQESGPGLVAPSQSLSVTCTVS GVSLPDYGVSWIRQPPRKGLEWLGVIWGSETTYYNSALKSRLTIIKDNSK SQVFLKMNSLQTDDTAIYYCAKHYYYGGSYAMDYWGQGTSVTVSSE |
| mCAR2 CAR-aa | 1939 | DIQMTQTTSSLSASLGDRVTISCRASQDISKYLNWYQQKPDGTVKLLIYH TSRLHSGVPSRFSGSGSGTDYSLTISNLEQEDIATYFCQQGNTLPYTFGG GTKLEITGSTSGSGKPGSGEGSTKGEVKLQESGPGLVAPSQSLSVTCTVS GVSLPDYGVSWIRQPPRKGLEWLGVIWGSETTYYNSALKSRLTIIKDNSK SQVFLKMNSLQTDDTAIY YCAKHYYYGGSYAMDYWGQGTSVTVSSESKYGPPCPPCPMFWVLVVVGGV LACYSLLVTVAFIIFWVKRGRKKLLYIFKQPFMRPVQTTQEEDGCSCRFE EEEGGCELRVKFSRSADAPAYQQGQNQLYNELNLGRREEYDVLDKRRGRD PEMGGKPRRKNPQEGLYNELQKDKMAEAYSEIGMKGERRRGKGHDGLYQG LSTATKDTYDALHMQALPPRL |
| mCAR2 Full-aa | 1940 | DIQMTQTT SSLSASLGDR VTISCRASQD ISKYLNWYQQ KPDGTVKLLI YHTSRLHSGV PSRFSGSGSG TDYSLTISNL EQEDIATYFC QQGNTLPYTF GGGTKLEITG STSGSGKPGS GEGSTKGEVK LQESGPGLVA PSQSLSVTCT VSGVSLPDYG VSWIRQPPRK GLEWLGVIWG SETTYYNSAL KSRLTIIKDN SKSQVFLKMN SLQTDDTAIY YCAKHYYYGG SYAMDYWGQG TSVTVSSESK YGPPCPPCPM FWVLVVVGGV LACYSLLVTV AFIIFWVKRG RKKLLYIFKQ PFMRPVQTTQ EEDGCSCRFE EEEGGCELRV KFSRSADAPA YQQGQNQLYN ELNLGRREEY DVLDKRRGRD PEMGGKPRRK NPQEGLYNEL QKDKMAEAYS EIGMKGERRR GKGHDGLYQG LSTATKDTYD ALHMQALPPR LEGGGEGRGS LLTCGDVEEN PGPRMLLLVT SLLLCELPHP AFLLIPRKVC NGIGIGEFKD SLSINATNIK HFKNCTSISG DLHILPVAFR GDSFTHTPPL DPQELDILKT VKEITGFLLI QAWPENRTDL HAFENLEIIR GRTKQHGQFS LAVVSLNITS LGLRSLKEIS DGDVIISGNK NLCYANTINW KKLFGTSGQK TKIISNRGEN SCKATGQVCH ALCSPEGCWG PEPRDCVSCR NVSRGRECVD KCNLLEGEPR EFVENSECIQ CHPECLPQAM NITCTGRGPD NCIQCAHYID GPHCVKTCPA GVMGENNTLV WKYADAGHVC HLCHPNCTYG CTGPGLEGCP TNGPKIPSIA TGMVGALLLL LVVALGIGLF M |

TABLE 3-continued

CD19 CAR Constructs

| Name | SEQ ID NO: | Sequence |
|---|---|---|
| mCAR3 scFv | 411 | DIQMTQTTSSLSASLGDRVTISCRASQDISKYLNWYQQKPDGTVKLLIYH<br>TSRLHSGVPSRFSGSGSGTDYSLTISNLEQEDIATYFCQQGNTLPYTFGG<br>GTKLEITGSTSGSGKPGSGEGSTKGEVKLQESGPGLVAPSQSLSVTCTVS<br>GVSLPDYGVSWIRQPPRKGLEWLGVIWGSETTYYNSALKSRLTIIKDNSK<br>SQVFLKMNSLQTDDTAIYYCAKHYYYGGSYAMDYWGQGTSVTVSS |
| mCAR3 Full-aa | 1941 | DIQMTQTTSSLSASLGDRVTISCRASQDISKYLNWYQQKPDGTVKLLIYH<br>TSRLHSGVPSRFSGSGSGTDYSLTISNLEQEDIATYFCQQGNTLPYTFGG<br>GTKLEITGSTSGSGKPGSGEGSTKGEVKLQESGPGLVAPSQSLSVTCTVS<br>GVSLPDYGVSWIRQPPRKGLEWLGVIWGSETTYYNSALKSRLTIIKDNSK<br>SQVFLKMNSLQTDDTAIYYCAKHYYYGGSYAMDYWGQGTSVTVSSAAAIE<br>VMYPPPYLDNEKSNGTIIHVKGKHLCPSPLFPGPSKPFWVLVVVGGVLAC<br>YSLLVTVAFIIFWVRSKRSRLLHSDYMNMTPRRPGPTRKHYQPYAPPRDF<br>AAYRSRVKFSRSADAPAYQQGQNQLYNELNLGRREEYDVLDKRRGRDPEM<br>GGKPRRKNPQEGLYNELQKDKMAEAYSEIGMKGERRRGKGHDGLYQGLST<br>ATKDTYDALHMQALPPR |
| SSJ25-C1 VH sequence | 416 | QVQLLESGAELVRPGSSVKISCKASGYAFSSYWMNWVKQRPGQGLEWIGQ<br>IYPGDGDTNYNGKFKGQATLTADKSSSTAYMQLSGLTSEDSAVYSCARKT<br>ISSVVDFYFDYWGQGTTVT |
| SSJ25-C1 VL sequence | 1942 | ELVLTQSPKFMSTSVGDRVSVTCKASQNVGTNVAWYQQKPGQSPKPLIYS<br>ATYRNSGVPDRFTGSGSGTDFTLTITNVQSKDLADYFYCQYNRYPYTSG<br>GGTKLEIKRRS |

In some embodiments, the CD19 CAR or binding domain includes the amino acid sequence of CTL019, or is encoded by the nucleotide sequence of CTL019 according to Table 3 with or without the leader sequence or the his tag, or a sequence substantially identical thereto (e.g., at least 85%, 90%, 95% or higher identity).

In some embodiments, the CDRs are defined according to the Kabat numbering scheme, the Chothia numbering scheme, or a combination thereof.

The sequences of humanized CDR sequences of the scFv domains are shown in Table 4A for the heavy chain variable domains and in Table 4B for the light chain variable domains. "ID" stands for the respective SEQ ID NO for each CDR.

TABLE 4A

Heavy Chain Variable Domain CDRs (according to Kabat)

| Candidate | FW | HCDR1 | HCDR2 | SEQ ID HCDR2 | HCDR3 | SEQ ID HCDR3 | SEQ ID |
|---|---|---|---|---|---|---|---|
| murine_CART19 | | DYGVS | VIWGSETTYYNSALKS | 958 | HYYYGGSYAMDY | 959 | 960 |
| humanized_CART19 a | VH4 | DYGVS | VIWGSETTYY*SS*LKS | 958 | HYYYGGSYAMDY | 961 | 960 |
| humanized_CART19 b | VH4 | DYGVS | VIWGSETTYY*QSS*LKS | 958 | HYYYGGSYAMDY | 962 | 960 |
| humanized_CART19 c | VH4 | DYGVS | VIWGSETTYYNS*S*LKS | 958 | HYYYGGSYAMDY | 963 | 960 |

TABLE 4B

Light Chain Variable Domain CDRs (according to Kabat)

| Candidate | FW | LCDR1 | LCDR2 | SEQ ID LCDR2 | LCDR3 | SEQ ID LCDR3 | SEQ ID |
|---|---|---|---|---|---|---|---|
| murine_CART19 | | RASQDISKYLN | HTSRLHS | 964 | QQGNTLPYT | 965 | 966 |
| humanized_CART19 a | VK3 | RASQDISKYLN | HTSRLHS | 964 | QQGNTLPYT | 965 | 966 |

TABLE 4B-continued

Light Chain Variable Domain CDRs (according to Kabat)

| Candidate | FW | LCDR1 | SEQ ID NO: | LCDR2 | SEQ ID NO: | LCDR3 | SEQ ID NO: |
|---|---|---|---|---|---|---|---|
| humanized_CART19 b | VK3 | RASQDISKYLN | 964 | HTSRLHS | 965 | QQGNTLPYT | 966 |
| humanized_CART19 c | VK3 | RASQDISKYLN | 964 | HTSRLHS | 965 | QQGNTLPYT | 966 |

BCMA CAR

In one embodiment, the CAR molecule comprises a BCMA CAR molecule described herein, e.g., a BCMA CAR described in US-2016-0046724-A1 or WO2016/014565. In embodiments, the BCMA CAR comprises an amino acid, or has a nucleotide sequence of a CAR molecule, or an antigen binding domain according to US-2016-0046724-A1, or Table 1 or 16, SEQ ID NO: 271 or SEQ ID NO: 273 of WO2016/014565, incorporated herein by reference, or a sequence substantially identical to any of the aforesaid sequences (e.g., at least 85%, 90%, 95% or more identical to any of the aforesaid BCMA CAR sequences). The amino acid and nucleotide sequences encoding the BCMA CAR molecules and antigen binding domains (e.g., including one, two, three VH CDRs; and one, two, three VL CDRs according to Kabat or Chothia), are specified in WO2016/014565.

In embodiments, the BCMA CAR comprises an anti-BCMA binding domain (e.g., human or humanized anti-BCMA binding domain), a transmembrane domain, and an intracellular signaling domain, and wherein said anti-BCMA binding domain comprises a heavy chain complementary determining region 1 (HC CDR1), a heavy chain complementary determining region 2 (HC CDR2), and a heavy chain complementary determining region 3 (HC CDR3) of any anti-BMCA heavy chain binding domain amino acid sequences listed in Table 5 or 6, or a sequence at least 85%, 90%, 95% or more identical thereto (e.g., having less than 5, 4, 3, 2 or 1 amino acid substitutions, e.g., conservative substitutions).

In one embodiment, the anti-BCMA binding domain comprises a light chain variable region described herein (e.g., in Table 5 or 6) and/or a heavy chain variable region described herein (e.g., in Table 5 or 6), or a sequence at least 85%, 90%, 95% or more identical thereto.

In one embodiment, the encoded anti-BCMA binding domain is a scFv comprising a light chain and a heavy chain of an amino acid sequence of Table 5 or 6.

In an embodiment, the human or humanized anti-BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 5 or 6, or a sequence at least 85%, 90%, 95% or more identical thereto; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 5 or 6, or a sequence at least 85%, 90%, 95% or more identical thereto.

TABLE 5

Amino Acid and Nucleic Acid Sequences of exemplary anti-BCMA scFv domains and BCMA CAR molecules

| Name/ Description | SEQ ID NO: | Sequence |
|---|---|---|
| 139109 | | |
| 139109-aa ScFv domain | 967 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIQLTQSPSSLSASVGDR VTITCRASQSISSYLNWYQQKPGKAPKLLIYAASSLQSGVPSRFSGSGSG TDFTLTISSLQPEDFATYYCQQSYSTPYTFGQGTKVEIK |
| 139109-nt ScFv domain | 968 | GAAGTGCAATTGGTGGAATCAGGGGGAGGACTTGTGCAGCCTGGAGGATC GCTGAGACTGTCATGTGCCGTGTCCGGCTTTGCCCTGTCCAACCACGGGA TGTCCTGGGTCCGCCGCGCGCCTGGAAAGGGCCTCGAATGGGTGTCGGGT ATTGTGTACAGCGGTAGCACCTACTATGCCGCATCCGTGAAGGGGAGATT CACCATCAGCCGGGACAACTCCAGGAACACTCTGTACCTCCAAATGAATT CGCTGAGGCCAGAGGACACTGCCATCTACTACTGCTCCGCGCATGGCGGA GAGTCCGACGTCTGGGGACAGGGGACCACCGTGACCGTGTCTAGCGCGTC CGGCGGAGGCGGCAGCGGGGGTCGGGCATCAGGGGGCGGCGGATCGGACA TCCAGCTCACCCAGTCCCCGAGCTCGCTGTCCGCCTCCGTGGGAGATCGG GTCACCATCACGTGCCGCGCCAGCCAGTCGATTTCCTCCTACCTGAACTG GTACCAACAGAAGCCCGGAAAAGCCCCGAAGCTTCTCATCTACGCCGCCT CGAGCCTGCAGTCAGGAGTGCCCTCACGGTTCTCCGGCTCCGGTTCCGGT ACTGATTTCACCCTGACCATTTCCTCCCTGCAACCGGAGGACTTCGCTAC TTACTACTGCCAGCAGTCGTACTCCACCCCCTACACTTTCGGACAAGGCA CCAAGGTCGAAATCAAG |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| 139109-aa VH | 969 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139109-aa VL | 970 | DIQLTQSPSSLSASVGDRVTITCRASQSISSYLNWYQQKPGKAPKLLIYA ASSLQSGVPSRFSGSGSGTDFTLTISSLQPEDFATYYCQQSYSTPYTFGQ GTKVEIK |
| 139109-aa Full CAR | 971 | MALPVTALLLPLALLLHAARPEVQLVESGGGLVQPGGSLRLSCAVSGFAL SNHGMSWVRRAPGKGLEWVSGIVYSGSTYYAASVKGRFTISRDNSRNTLY LQMNSLRPEDTAIYYCSAHGGESDVWGQGTTVTVSSASGGGGSGGRASGG GGSDIQLTQSPSSLSASVGDRVTITCRASQSISSYLNWYQQKPGKAPKLL IYAASSLQSGVPSRFSGSGSGTDFTLTISSLQPEDFATYYCQQSYSTPYT FGQGTKVEIKTTTPAPRPPTPAPTIASQPLSLRPEACRPAAGGAVHTRGL DFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRR EEYDVLDKRRGRDPEMGGKPRRKNPQEGLYNELQKDKMAEAYSEIGMKGE RRRGKGHDGLYQGLSTATKDTYDALHMQALPPR |
| 139109-nt Full CAR | 972 | ATGGCCCTCCCTGTCACCGCCCTGCTGCTTCCGCTGGCTCTTCTGCTCCA CGCCGCTCGGCCCGAAGTGCAATTGGTGGAATCAGGGGGAGGACTTGTGC AGCCTGGAGGATCGCTGAGACTGTCATGTGCCGTGTCCGGCTTTGCCCTG TCCAACCACGGGATGTCCTGGGTCCGCCGCGCGCCTGGAAAGGGCCTCGA ATGGGTGTCGGGTATTGTGTACAGCGGTAGCACCTACTATGCCGCATCCG TGAAGGGGAGATTCACCATCAGCCGGGACAACTCCAGGAACACTCTGTAC CTCCAAATGAATTCGCTGAGGCCAGAGGACACTGCCATCTACTACTGCTC CGCGCATGGCGGAGAGTCCGACGTCTGGGGACAGGGGACCACCGTGACCG TGTCTAGCGCGTCCGGCGGAGGCGGCAGCGGGGGTCGGGCATCAGGGGGC GGCGGATCGGACATCCAGCTCACCCAGTCCCCGAGCTCGCTGTCCGCCTC CGTGGGAGATCGGGTCACCATCACGTGCCGCGCCAGCCAGTCGATTTCCT CCTACCTGAACTGGTACCAACAGAAGCCCGGAAAAGCCCCGAAGCTTCTC ATCTACGCCGCCTCGAGCCTGCAGTCAGGAGTGCCCTCACGGTTCTCCGG CTCCGGTTCCGGTACTGATTTCACCCTGACCATTTCCTCCCTGCAACCGG AGGACTTCGCTACTTACTACTGCCAGCAGTCGTACTCCACCCCCTACACT TTCGGACAAGGCACCAAGGTCGAAATCAAGACCACTACCCCAGCACCGAG GCCACCCACCCCGGCTCCTACCATCGCCTCCCAGCCTCTGTCCCTGCGTC CGGAGGCATGTAGACCCGCAGCTGGTGGGCCGTGCATACCCGGGGTCTT GACTTCGCCTGCGATATCTACATTTGGGCCCCTCTGGCTGGTACTTGCGG GGTCCTGCTGCTTTCACTCGTGATCACTCTTTACTGTAAGCGCGGTCGGA AGAAGCTGCTGTACATCTTTAAGCAACCCTTCATGAGGCCTGTGCAGACT ACTCAAGAGGAGGACGGCTGTTCATGCCGGTTCCCAGAGGAGGAGGAAGG CGGCTGCGAACTGCGCGTGAAATTCAGCCGCAGCGCAGATGCTCCAGCCT ACAAGCAGGGGCAGAACCAGCTCTACAACGAACTCAATCTTGGTCGGAGA GAGGAGTACGACGTGCTGGACAAGCGGAGAGGACGGGACCCAGAAATGGG CGGGAAGCCGCGCAGAAAGAATCCCCAAGAGGGCCTGTACAACGAGCTCC AAAAGGATAAGATGGCAGAAGCCTATAGCGAGATTGGTATGAAAGGGGAA CGCAGAAGAGGCAAAGGCCACGACGGACTGTACCAGGGACTCAGCACCGC CACCAAGGACACCTATGACGCTCTTCACATGCAGGCCCTGCCGCCTCGG |

139103

| 139103-aa ScFv domain | 973 | QVQLVESGGGLVQPGRSLRLSCAASGFTFSNYAMSWVRQAPGKGLGWVSG ISRSGENTYYADSVKGRFTISRDNSKNTLYLQMNSLRDEDTAVYYCARSP AHYYGGMDVWGQGTTVTVSSASGGGGSGGRASGGGGSDIVLTQSPGTLSL SPGERATLSCRASQSISSSFLAWYQQKPGQAPRLLIYGASRRATGIPDRF SGSGSGTDFTLTISRLEPEDSAVYYCQQYHSSPSWTFGQGTKLEIK |
| 139103-nt ScFv domain | 974 | CAAGTGCAACTCGTGGAATCTGGTGGAGGACTCGTGCAACCCGGAAGATC GCTTAGACTGTCGTGTGCCGCCAGCGGGTTCACTTTCTCGAACTACGCGA TGTCCTGGGTCCGCCAGGCACCCGGAAAGGGACTCGGTTGGGTGTCCGGA ATTTCCCGGTCCGGCGAAAATACCTACTACGCCGACTCCGTGAAGGGCCG CTTCACCATCTCAAGGGACAACAGCAAAAACACCCTGTACTTGCAAATGA ACTCCCTGCGGGATGAAGATACAGCCGTGTACTATTGCGCCCGGTCGCCT GCCCATTACTACGGCGGAATGGACGTCTGGGGACAGGGAACCACTGTGAC TGTCAGCAGCGCGTCGGGTGGCGGCGGCTCAGGGGGTCGGGCCTCCGGGG GGGAGGGTCCGACATCGTGCTGACCCAGTCCCCGGGAACCCTGAGCCTG AGCCCGGGAGAGCGCGCGACCCTGTCATGCCGGGCATCCCAGAGCATTAG CTCCTCCTTTCTCGCCTGGTATCAGCAGAAGCCCGGACAGGCCCCGAGGC TGCTGATCTACGGCGCTAGCAGAAGGGCTACCGGAATCCCAGACCGGTTC TCCGGCTCCGGTTCCGGGACCGATTTCACCCTTACTATCTCGCGCCTGGA ACCTGAGGACTCCGCCGTCTACTACTGCCAGCAGTACCACTCATCCCCGT CGTGGACGTTCGGACAGGGCACCAAGCTGGAGATTAAG |

TABLE 5-continued

Amino Acid and Nucleic Acid Sequences of exemplary
anti-BCMA scFv domains and BCMA CAR molecules

| Name/Description | SEQ ID NO: | Sequence |
|---|---|---|
| 139103-aa VH | 975 | QVQLVESGGGLVQPGRSLRLSCAASGFTFSNYAMSWVRQAPGKGLGWVSG ISRSGENTYYADSVKGRFTISRDNSKNTLYLQMNSLRDEDTAVYYCARSP AHYYGGMDVWGQGTTVTVSS |
| 139103-aa VL | 976 | DIVLTQSPGTLSLSPGERATLSCRASQSISSSFLAWYQQKPGQAPRLLIY GASRRATGIPDRFSGSGSGTDFTLTISRLEPEDSAVYYCQQYHSSPSWTF GQGTKLEIK |
| 139103-aa Full CAR | 977 | MALPVTALLLPLALLLHAARPQVQLVESGGGLVQPGRSLRLSCAASGFTF SNYAMSWVRQAPGKGLGWVSGISRSGENTYYADSVKGRFTISRDNSKNTL YLQMNSLRDEDTAVYYCARSPAHYYGGMDVWGQGTTVTVSSASGGGGSGG RASGGGGSDIVLTQSPGTLSLSPGERATLSCRASQSISSSFLAWYQQKPG QAPRLLIYGASRRATGIPDRFSGSGSGTDFTLTISRLEPEDSAVYYCQQY HSSPSWTFGQGTKLEIKTTTPAPRPPTPAPTIASQPLSLRPEACRPAAGG AVHTRGLDFACDIYIWAPLAGTCGVLLLSLVITLYCKRGRKKLLYIFKQP FMRPVQTTQEEDGCSCRFPEEEEGGCELRVKFSRSADAPAYKQGQNQLYN ELNLGRREEYDVLDKRRGRDPEMGGKPRRKNPQEGLYNELQKDKMAEAYS EIGMKGERRRGKGHDGLYQGLSTATKDTYDALHMQALPPR |
| 139103-nt Full CAR | 978 | ATGGCCCTCCCTGTCACCGCCCTGCTGCTTCCGCTGGCTCTTCTGCTCCA CGCCGCTCGGCCCCAAGTGCAACTCGTGGAATCTGGTGGAGGACTCGTGC AACCCGGAAGATCGCTTAGACTGTCGTGTGCCGCCAGCGGGTTCACTTTC TCGAACTACGCGATGTCCTGGGTCCGCCAGGCACCCGGAAAGGGACTCGG TTGGGTGTCCGGCATTTCCCGGTCCGGCGAAAATACCTACTACGCCGACT CCGTGAAGGGCCGCTTCACCATCTCAAGGGACAACAGCAAAAACACCCTG TACTTGCAAATGAACTCCCTGCGGGATGAAGATACAGCCGTGTACTATTG CGCCCGGTCGCCTGCCCATTACTACGGCGGAATGGACGTCTGGGGACAGG GAACCACTGTGACTGTCAGCAGCGCGTCGGGTGGCGGCGGCTCAGGGGGT CGGGCCTCCGGGGGGGAGGGTCCGACATCGTGCTGACCCAGTCCCCGGG AACCCTGAGCCTGAGCCCGGGAGAGCGCGCGACCCTGTCATGCCGGGCAT CCCAGAGCATTAGCTCCTCCTTTCTCGCCTGGTATCAGCAGAAGCCCGGA CAGGCCCCGAGGCTGCTGATCTACGGCGCTAGCAGAAGGGCTACCGGAAT CCCAGACCGGTTCTCCGGCTCCGGTTCCGGGACCGATTTCACCCTTACTA TCTCGCGCCTGGAACCTGAGGACTCCGCCGTCTACTACTGCCAGCAGTAC CACTCATCCCCGTCGTGGACGTTCGGACAGGGCACCAAGCTGGAGATTAA GACCACTACCCCAGCACCGAGGCCACCCACCCCGGCTCCTACCATCGCCT CCCAGCCTCTGTCCCTGCGTCCGGAGGCATGTAGACCCGCAGCTGGTGGG GCCGTGCATACCCGGGGTCTTGACTTCGCCTGCGATATCTACATTTGGGC CCCTCTGGCTGGTACTTGCGGGGTCCTGCTGCTTTCACTCGTGATCACTC TTTACTGTAAGCGCGGTCGGAAGAAGCTGCTGTACATCTTTAAGCAACCC TTCATGAGGCCTGTGCAGACTACTCAAGAGGAGGACGGCTGTTCATGCCG GTTCCCAGAGGAGGAGGAAGGCGGCTGCGAACTGCGCGTGAAATTCAGCC GCAGCGCAGATGCTTCCAGCCTACAAGCAGGGGCAGAACCAGCTCTACAAC GAACTCAATCTTGGTCGGAGAGAGGAGTACGACGTGCTGGACAAGCGGAG AGGACGGGACCCAGAAATGGGCGGGAAGCCGCGCAGAAAGAATCCCCAAG AGGGCCTGTACAACGAGCTCCAAAAGGATAAGATGGCAGAAGCCTATAGC GAGATTGGTATGAAAGGGGAACGCAGAAGAGGCAAAGGCCACGACGGACT GTACCAGGGACTCAGCACCGCCACCAAGGACACCTATGACGCTCTTCACA TGCAGGCCCTGCCGCCTCGG |

139105

| | | |
|---|---|---|
| 139105-aa ScFv domain | 979 | QVQLVESGGGLVQPGRSLRLSCAASGFTFDDYAMHWVRQAPGKGLEWVSG ISWNSGSIGYADSVKGRFTISRDNAKNSLYLQMNSLRAEDTALYYCSVHS FLAYWGQGTLVTVSSASGGGGSGGRASGGGGSDIVMTQTPLSLPVTPGEP ASISCRSSQSLLHSNGYNYLDWYLQKPGQSPQLLIYLGSNRASGVPDRFS GSGSGTDFTLKISRVEAEDVGVYYCMQALQTPYTFGQGTKVEIK |
| 139105-nt ScFv domain | 980 | CAAGTGCAACTCGTCGAATCCGGTGGAGGTCTGGTCCAACCTGGTAGAAG CCTGAGACTGTCGTGTGCGGCCAGCGGATTCACCTTTGATGACTATGCTA TGCACTGGGTGCGGCAGGCCCCAGGAAAGGGCCTGGAATGGGTGTCGGGA ATTAGCTGGAACTCCGGGTCCATTGGCTACGCCGACTCCGTGAAGGGCCG CTTCACCATCTCCCGCGACAACGCAAAGAACTCCCTGTACTTGCAAATGA ACTCGCTCAGGGCTGAGGATACCGCGCTGTACTACTGCTCCGTGCATTCC TTCCTGGCCTACTGGGGACAGGGAACTCTGGTCACCGTGTCGAGCGCCTC CGGCGGCGGGGGCTCGGGTGGACGGGCCTCGGGCGGAGGGGGGTCCGACA TCGTGATGACCCAGACCCCGCTGAGCTTGCCCGTGACTCCCGGAGAGCCT GCATCCATCTCCTGCCGGTCATCCCAGTCCCTTCTCCACTCCAACGGATA CAACTACCTCGACTGGTACCTCCAGAAGCCGGGACAGAGCCCTCAGCTTC TGATCTACCTGGGGTCAAATAGAGCCTCAGGAGTGCCGGATCGGTTCAGC GGATCTGGTTCGGGAACTGATTTCACTCTGAAGATTTCCCGCGTGGAAGC CGAGGACGTGGGCGTCTACTACTGTATGCAGGCGCTGCAGACCCCCTATA CCTTCGGCCAAGGGACGAAAGTGGAGATCAAG |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| 139105-aa<br>VH | 981 | QVQLVESGGGLVQPGRSLRLSCAASGFTFDDYAMHWVRQAPGKGLEWVSG<br>ISWNSGSIGYADSVKGRFTISRDNAKNSLYLQMNSLRAEDTALYYCSVHS<br>FLAYWGQGTLVTVSS |
| 139105-aa<br>VL | 982 | DIVMTQTPLSLPVTPGEPASISCRSSQSLLHSNGYNYLDWYLQKPGQSPQ<br>LLIYLGSNRASGVPDRFSGSGSGTDFTLKISRVEAEDVGVYYCMQALQTP<br>YTFGQGTKVEIK |
| 139105-aa<br>Full CAR | 983 | MALPVTALLLPLALLLHAARPQVQLVESGGGLVQPGRSLRLSCAASGFTF<br>DDYAMHWVRQAPGKGLEWVSGISWNSGSIGYADSVKGRFTISRDNAKNSL<br>YLQMNSLRAEDTALYYCSVHSFLAYWGQGTLVTVSSASGGGGSGGRASGG<br>GGSDIVMTQTPLSLPVTPGEPASISCRSSQSLLHSNGYNYLDWYLQKPGQ<br>SPQLLIYLGSNRASGVPDRFSGSGSGTDFTLKISRVEAEDVGVYYCMQAL<br>QTPYTFGQGTKVEIKTTTPAPRPPTPAPTIASQPLSLRPEACRPAAGGAV<br>HTRGLDFACDIYIWAPLAGTCGVLLLSLVITLYCKRGRKKLLYIFKQPFM<br>RPVQTTQEEDGCSCRFPEEEEGGCELRVKFSRSADAPAYKQGQNQLYNEL<br>NLGRREEYDVLDKRRGRDPEMGGKPRRKNPQEGLYNELQKDKMAEAYSEI<br>GMKGERRRGKGHDGLYQGLSTATKDTYDALHMQALPPR |
| 139105-nt<br>Full CAR | 984 | ATGGCCCTCCCTGTCACCGCCCTGCTGCTTCCGCTGGCTCTTCTGCTCCA<br>CGCCGCTCGGCCCCAAGTGCAACTCGTCGAATCCGGTGGAGGTCTGGTCC<br>AACCTGGTAGAAGCCTGAGACTGTCGTGTGCGGCCAGCGGATTCACCTTT<br>GATGACTATGCTATGCACTGGGTGCGGCAGGCCCCAGGAAAGGGCCTGGA<br>ATGGGTGTCGGGAATTAGCTGGAACTCCGGGTCCATTGGCTACGCCGACT<br>CCGTGAAGGGCCGCTTCACCATCTCCCGCGACAACGCAAGAACTCCCTG<br>TACTTGCAAATGAACTCGCTCAGGGCTGAGGATACCGCGCTGTACTACTG<br>CTCCGTGCATTCCTTCCTGGCCTACTGGGGACAGGGAACTCTGGTCACCG<br>TGTCGAGCGCCTCCGGCGGCGGGGGCTCGGGTGGACGGGCCTCGGGCGGA<br>GGGGGGTCCGACATCGTGATGACCCAGACCCCGCTGAGCTTGCCCGTGAC<br>TCCCGGAGAGCCTGCATCCATCTCCTGCCGGTCATCCCAGTCCCTTCTCC<br>ACTCCAACGGATACAACTACCTCGACTGGTACCTCCAGAAGCCGGGACAG<br>AGCCCTCAGCTTCTGATCTACCTGGGGTCAAATAGAGCCTCAGGAGTGCC<br>GGATCGGTTCAGCGGATCTGGTTCGGGAACTGATTTCACTCTGAAGATTT<br>CCCGCGTGGAAGCCGAGGACGTGGGCGTCTACTACTGTATGCAGGCGCTG<br>CAGACCCCCTATACCTTCGGCCAAGGGACGAAAGTGGAGATCAAGACCAC<br>TACCCCAGCACCGAGGCCACCCACCCCGGCTCCTACCATCGCCTCCCAGC<br>CTCTGTCCCTGCGTCCGGAGGCATGTAGACCCGCAGCTGGTGGGGCCGTG<br>CATACCCGGGGTCTTGACTTCGCCTGCGATATCTACATTTGGGCCCCTCT<br>GGCTGGTACTTGCGGGGTCCTGCTGCTTTCACTCGTGATCACTCTTTACT<br>GTAAGCGCGGTCGGAAGAAGCTGCTGTACATCTTTAAGCAACCCTTCATG<br>AGGCCTGTGCAGACTACTCAAGAGGAGGACGGCTGTTCATGCCGGTTCCC<br>AGAGGAGGAGGAAGGCGGCTGCGAACTGCGCGTGAAATTCAGCCGCAGCG<br>CAGATGCTCCAGCCTACAAGCAGGGGCAGAACCAGCTCTACAACGAACTC<br>AATCTTGGTCGGAGAGAGGAGTACGACGTGCTGGACAAGCGGAGAGGACG<br>GGACCCAGAAATGGGCGGGAAGCCGCGCAGAAAGAATCCCCAAGAGGGCC<br>TGTACAACGAGCTCCAAAAGGATAAGATGGCAGAAGCCTATAGCGAGATT<br>GGTATGAAAGGGGAACGCAGAAGAGGCAAAGGCCACGACGGACTGTACCA<br>GGGACTCAGCACCGCCACCAAGGACACCTATGACGCTCTTCACATGCAGG<br>CCCTGCCGCCTCGG |

139111

| 139111-aa<br>ScFv domain | 985 | EVQLLESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSDIVMTQTPLSLSVTPGQP<br>ASISCKSSQSLLRNDGKTPLYWYLQKAGQPPQLLIYEVSNRFSGVPDRFS<br>GSGSGTDFTLKISRVEAEDVGAYYCMQNIQFPSFGGGTKLEIK |
| 139111-nt<br>ScFv domain | 986 | GAAGTGCAATTGTTGGAATCTGGAGGAGGACTTGTGCAGCCTGGAGGATC<br>ACTGAGACTTTCGTGTGCGGTGTCAGGCTTCGCCCTGAGCAACCACGGCA<br>TGAGCTGGGTGCGAGAGCCCCGGGGAAGGGTCTGGAATGGGTGTCCGGG<br>ATCGTCTACTCCGGTTCAACTTACTACGCCGCAAGCGTGAAGGGTCGCTT<br>CACCATTTCCCGCGATAACTCCCGGAACACCCTGTACCTCCAAATGAACT<br>CCCTGCGGCCCGAGGACACCGCCATCTACTACTGTTCCGCGCATGGAGGA<br>GAGTCCGATGTCTGGGGACAGGGCACTACCGTGACCGTGTCGAGCGCCTC<br>GGGGGGAGGAGGCTCCGGCGGTCGCGCCTCCGGGGGGGTGGCAGCGACA<br>TTGTGATGACGCAGACTCCACTCTCGCTGTCCGTGACCCCGGGACAGCCC<br>GCGTCCATCTCGTGCAAGAGCTCCCAGAGCCTGCTGAGGAACGACGGAAA<br>GACTCCTCTGTATTGGTACCTCCAGAAGGCTGGACAGCCCCGCAACTGC<br>TCATCTACGAAGTGTCAAATCGCTTCTCCGGGGTGCCGGATCGGTTTTCC |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| | | GGCTCGGGATCGGGCACCGACTTCACCCTGAAAATCTCCAGGGTCGAGGC CGAGGACGTGGGAGCCTACTACTGCATGCAAAACATCCAGTTCCCTTCCT TCGGCGGCGGCACAAAGCTGGAGATTAAG |
| 139111-aa VH | 987 | EVQLLESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139111-aa VL | 988 | DIVMTQTPLSLSVTPGQPASISCKSSQSLLRNDGKTPLYWYLQKAGQPPQ LLIYEVSNRFSGVPDRFSGSGSGTDFTLKISRVEAEDVGAYYCMQNIQFP SFGGGTKLEIK |
| 139111-aa Full CAR | 989 | MALPVTALLLPLALLLHAARPEVQLLESGGGLVQPGGSLRLSCAVSGFAL SNHGMSWVRRAPGKGLEWVSGIVYSGSTYYAASVKGRFTISRDNSRNTLY LQMNSLRPEDTAIYYCSAHGGESDVWGQGTTVTVSSASGGGGSGGRASGG GGSDIVMTQTPLSLSVTPGQPASISCKSSQSLLRNDGKTPLYWYLQKAGQ PPQLLIYEVSNRFSGVPDRFSGSGSGTDFTLKISRVEAEDVGAYYCMQNI QFPSFGGGTKLEIKTTTPAPRPPTPAPTIASQPLSLRPEACRPAAGGAVH TRGLDFACDIYIWAPLAGTCGVLLLSLVITLYCKRGRKKLLYIFKQPFMR PVQTTQEEDGCSCRFPEEEEGGCELRVKFSRSADAPAYKQGQNQLYNELN LGRREEYDVLDKRRGRDPEMGGKPRRKNPQEGLYNELQKDKMAEAYSEIG MKGERRRGKGHDGLYQGLSTATKDTYDALHMQALPPR |
| 139111-nt Full CAR | 990 | ATGGCCCTCCCTGTCACCGCCCTGCTGCTTCCGCTGGCTCTTCTGCTCCA CGCCGCTCGGCCCGAAGTGCAATTGTTGGAATCTGGAGGAGGACTTGTGC AGCCTGGAGGATCACTGAGACTTTCGTGTGCGGTGTCAGGCTTCGCCCTG AGCAACCACGGCATGAGCTGGGTGCGGAGAGCCCCGGGGAAGGGTCTGGA ATGGGTGTCCGGGATCGTCTACTCCGGTTCAACTTACTACGCCGCAAGCG TGAAGGGTCGCTTCACCATTTCCCGCGATAACTCCCGGAACACCCTGTAC CTCCAAATGAACTCCCTGCGGCCCGAGGACACCGCCATCTACTACTGTTC CGCGCATGGAGGAGAGTCCGATGTCTGGGGACAGGGCACTACCGTGACCG TGTCGAGCGCCTCGGGGGAGGAGGCTCCGGCGGTCGCGCCTCCGGGGGG GGTGGCAGCGACATTGTGATGACGCAGACTCCACTCTCGCTGTCCGTGAC CCCGGGACAGCCCGCGTCCATCTCGTGCAAGAGCTCCCAGAGCCTGCTGA GGAACGACGGAAAGACTCCTCTGTATTGGTACCTCCAGAAGGCTGGACAG CCCCCGCAACTGCTCATCTACGAAGTGTCAAATCGCTTCTCCGGGGTGCC GGATCGGTTTTCCGGCTCGGGATCGGGCACCGACTTCACCCTGAAAATCT CCAGGGTCGAGGCCGAGGACGTGGGAGCCTACTACTGCATGCAAAACATC CAGTTCCCTTCCTTCGGCGGCGGCACAAAGCTGGAGATTAAGACCACTAC CCCAGCACCGAGGCCACCCACCCCGGCTCCTACCATCGCCTCCCAGCCTC TGTCCCTGCGTCCGGAGGCATGTAGACCCGCAGCTGGTGGGGCCGTGCAT ACCCGGGGTCTTGACTTCGCCTGCGATATCTACATTTGGGCCCCTCTGGC TGGTACTTGCGGGGTCCTGCTGCTTTCACTCGTGATCACTCTTTACTGTA AGCGCGGTCGGAAGAAGCTGCTGTACATCTTTAAGCAACCCTTCATGAGG CCTGTGCAGACTACTCAAGAGGAGGACGGCTGTTCATGCCGGTTCCCAGA GGAGGAGGAAGGCGGCTGCGAACTGCGCGTGAAATTCAGCCGCAGCGCAG ATGCTCCAGCCTACAAGCAGGGGCAGAACCAGCTCTACAACGAACTCAAT CTTGGTCGGAGAGAGGAGTACGACGTGCTGGACAAGCGGAGAGGACGGGA CCCAGAAATGGGCGGGAAGCCGCGCAGAAAGAATCCCCAAGAGGGCCTGT ACAACGAGCTCCAAAAGGATAAGATGGCAGAAGCCTATAGCGAGATTGGT ATGAAAGGGGAACGCAGAAGAGGCAAAGGCCACGACGGACTGTACCAGGG ACTCAGCACCGCCACCAAGGACACCTATGACGCTCTTCACATGCAGGCCC TGCCGCCTCGG |

139100

| 139100-aa ScFv domain | 991 | QVQLVQSGAEVRKTGASVKVSCKASGYIFDNFGINWVRQAPGQGLEWMGW INPKNNNTNYAQKFQGRVTITADESTNTAYMEVSSLRSEDTAVYYCARGP YYYQSYMDVWGQGTMVTVSSASGGGGSGGRASGGGGSDIVMTQTPLSLPV TPGEPASISCRSSQSLLHSNGYNYLNWYLQKPGQSPQLLIYLGSKRASGV PDRFSGSGSGTDFTLHITRVGAEDVGVYYCMQALQTPYTFGQGTKLEIK |
| 139100-nt ScFv domain | 992 | CAAGTCCAACTCGTCCAGTCCGGCGCAGAAGTCAGAAAAACCGGTGCTAG CGTGAAAGTGTCCTGCAAGGCCTCCGGCTACATTTTCGATAACTTCGGAA TCAACTGGGTCAGACAGGCCCCGGGCCAGGGGCTGGAATGGATGGGATGG ATCAACCCCAAGAACAACAACACCAACTACGCACAGAAGTTCCAGGGCCG CGTGACTATCACCGCCGATGAATCGACCAATACCGCCTACATGGAGGTGT CCTCCCTGCGGTCGGAGGACACTGCCGTGTATTACTGCGCGAGGGGCCCA TACTACTACCAAAGCTACATGGACGTCTGGGGACAGGGAACCATGGTGAC CGTGTCATCCGCCTCCGGTGGTGGAGGCTCCGGGGGCGGGCTTCAGGAG GCGGAGGAAGCGATATTGTGATGACCCAGACTCCGCTTAGCCTGCCCGTG ACTCCTGGAGAACCGGCCTCCATTTCCTGCCGGTCCTCGCAATCACTCCT GCATTCCAACGGTTACAACTACCTGAATTGGTACCTCCAGAAGCCTGGCC |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| | | AGTCGCCCCAGTTGCTGATCTATCTGGGCTCGAAGCGCGCCTCCGGGGTG CCTGACCGGTTTAGCGGATCTGGGAGCGGCACGGACTTCACTCTCCACAT CACCCGCGTGGGAGCGGAGGACGTGGGAGTGTACTACTGTATGCAGGCGC TGCAGACTCCGTACACATTCGGACAGGGCACCAAGCTGGAGATCAAG |
| 139100-aa VH | 993 | QVQLVQSGAEVRKTGASVKVSCKASGYIFDNFGINWVRQAPGQGLEWMGW INPKNNNTNYAQKFQGRVTITADESTNTAYMEVSSLRSEDTAVYYCARGP YYYQSYMDVWGQGTMVTVSS |
| 139100-aa VL | 994 | DIVMTQTPLSLPVTPGEPASISCRSSQSLLHSNGYNYLNWYLQKPGQSPQ LLIYLGSKRASGVPDRFSGSGSGTDFTLHITRVGAEDVGVYYCMQALQTP YTFGQGTKLEIK |
| 139100-aa Full CAR | 995 | MALPVTALLLPLALLLHAARPQVQLVQSGAEVRKTGASVKVSCKASGYIF DNFGINWVRQAPGQGLEWMGWINPKNNNTNYAQKFQGRVTITADESTNTA YMEVSSLRSEDTAVYYCARGPYYYQSYMDVWGQGTMVTVSSASGGGGSGG RASGGGGSDIVMTQTPLSLPVTPGEPASISCRSSQSLLHSNGYNYLNWYL QKPGQSPQLLIYLGSKRASGVPDRFSGSGSGTDFTLHITRVGAEDVGVYY CMQALQTPYTFGQGTKLEIKTTTPAPRPPTPAPTIASQPLSLRPEACRPA AGGAVHTRGLDFACDIYIWAPLAGTCGVLLLSLVITLYCKRGRKKLLYIF KQPFMRPVQTTQEEDGCSCRFPEEEEGGCELRVKFSRSADAPAYKQGQNQ LYNELNLGRREEYDVLDKRRGRDPEMGGKPRRKNPQEGLYNELQKDKMAE AYSEIGMKGERRRGKGHDGLYQGLSTATKDTYDALHMQALPPR |
| 139100-nt Full CAR | 996 | ATGGCCCTCCCTGTCACCGCCCTGCTGCTTCCGCTGGCTCTTCTGCTCCA CGCCGCTCGGCCCCAAGTCCAACTCGTCCAGTCCGGCGCAGAAGTCAGAA AAACCGGTGCTAGCGTGAAAGTGTCCTGCAAGGCCTCCGGCTACATTTTC GATAACTTCGGAATCAACTGGGTCAGACAGGCCCCGGGCCAGGGGCTGGA ATGGATGGGATGGATCAACCCCAAGAACAACAACACCAACTACGCACAGA AGTTCCAGGGCCGCGTGACTATCACCGCCGATGAATCGACCAATACCGCC TACATGGAGGTGTCCTCCCTGCGGTCGGAGGACACTGCCGTGTATTACTG CGCGAGGGGCCCATACTACTACCAAAGCTACATGGACGTCTGGGGACAGG GAACCATGGTGACCGTGTCATCCGCCTCCGGTGGTGGAGGCTCCGGGGGG CGGGCTTCAGGAGGCGGAGGAAGCGATATTGTGATGACCCAGACTCCGCT TAGCCTGCCCGTGACTCCTGGAGAACCGGCCTCCATTTCCTGCCGGTCCT CGCAATCACTCCTGCATTCCAACGGTTACAACTACCTGAATTGGTACCTC CAGAAGCCTGGCCAGTCGCCCCAGTTGCTGATCTATCTGGGCTCGAAGCG CGCCTCCGGGGTGCCTGACCGGTTTAGCGGATCTGGGAGCGGCACGGACT TCACTCTCCACATCACCCGCGTGGGAGCGGAGGACGTGGGAGTGTACTAC TGTATGCAGGCGCTGCAGACTCCGTACACATTCGGACAGGGCACCAAGCT GGAGATCAAGACCACTACCCCAGCACCGAGGCCACCCACCCCGGCTCCTA CCATCGCCTCCCAGCCTCTGTCCCTGCGTCCGGAGGCATGTAGACCCGCA GCTGGTGGGGCCGTGCATACCCGGGGTCTTGACTTCGCCTGCGATATCTA CATTTGGGCCCCTCTGGCTGGTACTTGCGGGGTCCTGCTGCTTTCACTCG TGATCACTCTTTACTGTAAGCGCGGTCGGAAGAAGCTGCTGTACATCTTT AAGCAACCCTTCATGAGGCCTGTGCAGACTACTCAAGAGGAGGACGGCTG TTCATGCCGGTTCCCAGAGGAGGAGGAAGGCGGCTGCGAACTGCGCGTGA AATTCAGCCGCAGCGCAGATGCTCCAGCCTACAAGCAGGGGCAGAACCAG CTCTACAACGAACTCAATCTTGGTCGGAGAGAGGAGTACGACGTGCTGGA CAAGCGGAGAGGACGGGACCCAGAAATGGGCGGGAAGCCGCGCAGAAAGA ATCCCCAAGAGGGCCTGTACAACGAGCTCCAAAAGGATAAGATGGCAGAA GCCTATAGCGAGATTGGTATGAAAGGGGAACGCAGAAGAGGCAAAGGCCA CGACGGACTGTACCAGGGACTCAGCACCGCCACCAAGGACACCTATGACG CTCTTCACATGCAGGCCCTGCCGCCTCGG |

139101

| 139101-aa ScFv domain | 997 | QVQLQESGGGLVQPGGSLRLSCAASGFTFSSDAMTWVRQAPGKGLEWVSV ISGSGGTTYYADSVKGRFTISRDNSKNTLYLQMNSLRAEDTAVYYCAKLD SSGYYYARGPRYWGQGTLVTVSSASGGGGSGGRASGGGGSDIQLTQSPSS LSASVGDRVTITCRASQSISSYLNWYQQKPGKAPKLLIYGASTLASGVPA RFSGSGSGTHFTLTINSLQSEDSATYYCQQSYKRASFGQGTKVEIK |
| 139101-nt ScFv domain | 998 | CAAGTGCAACTTCAAGAATCAGGCGGAGGACTCGTGCAGCCCGGAGGATC ATTGCGGCTCTCGTGCGCCGCCTCGGGCTTCACCTTCTCGAGCGACGCCA TGACCTGGGTCCGCCAGGCCCCGGGGAAGGGGCTGGAATGGGTGTCTGTG ATTTCCGGCTCCGGGGGAACTACGTACTACGCCGATTCCGTGAAAGGTCG CTTCACTATCTCCCGGGACAACAGCAAGAACACCCTTTATCTGCAAATGA ATTCCCTCCGCGCCGAGGACACCGCCGTGTACTACTGCGCCAAGCTGGAC TCCTCGGGCTACTACTATGCCCGGGGTCCGAGATACTGGGGACAGGGAAC CCTCGTGACCGTGTCCTCCGCGTCCGGCGGAGGAGGGTCGGGAGGGCGGG CCTCCGGCGGCGGCGGTTCGGACATCCAGCTGACCCAGTCCCCATCCTCA CTGAGCGCAAGCGTGGGCGACAGAGTCACCATTACATGCAGGGCGTCCCA |

TABLE 5-continued

Amino Acid and Nucleic Acid Sequences of exemplary
anti-BCMA scFv domains and BCMA CAR molecules

| Name/ Description | SEQ ID NO: | Sequence |
| --- | --- | --- |
| | | GAGCATCAGCTCCTACCTGAACTGGTACCAACAGAAGCCTGGAAAGGCTC<br>CTAAGCTGTTGATCTACGGGCTTCGACCCTGGCATCCGGGGTGCCCGCG<br>AGGTTTAGCGGAAGCGGTAGCGGCACTCACTTCACTCTGACCATTAACAG<br>CCTCCAGTCCGAGGATTCAGCCACTTACTACTGTCAGCAGTCCTACAAGC<br>GGGCCAGCTTCGGACAGGGCACTAAGGTCGAGATCAAG |
| 139101-aa VH | 999 | QVQLQESGGGLVQPGGSLRLSCAASGFTFSSDAMTWVRQAPGKGLEWVSV<br>ISGSGGTTYYADSVKGRFTISRDNSKNTLYLQMNSLRAEDTAVYYCAKLD<br>SSGYYYARGPRYWGQGTLVTVSS |
| 139101-aa VL | 1000 | DIQLTQSPSSLSASVGDRVTITCRASQSISSYLNWYQQKPGKAPKLLIYG<br>ASTLASGVPARFSGSGSGTHFTLTINSLQSEDSATYYCQQSYKRASFGQG<br>TKVEIK |
| 139101-aa Full CAR | 1001 | MALPVTALLLPLALLLHAARPQVQLQESGGGLVQPGGSLRLSCAASGFTF<br>SSDAMTWVRQAPGKGLEWVSVISGSGGTTYYADSVKGRFTISRDNSKNTL<br>YLQMNSLRAEDTAVYYCAKLDSSGYYYARGPRYWGQGTLVTVSSASGGGG<br>SGGRASGGGGSDIQLTQSPSSLSASVGDRVTITCRASQSISSYLNWYQQK<br>PGKAPKLLIYGASTLASGVPARFSGSGSGTHFTLTINSLQSEDSATYYCQ<br>QSYKRASFGQGTKVEIKTTTPAPRPPTPAPTIASQPLSLRPEACRPAAGG<br>AVHTRGLDFACDIYIWAPLAGTCGVLLLSLVITLYCKRGRKKLLYIFKQP<br>FMRPVQTTQEEDGCSCRFPEEEEGGCELRVKFSRSADAPAYKQGQNQLYN<br>ELNLGRREEYDVLDKRRGRDPEMGGKPRRKNPQEGLYNELQKDKMAEAYS<br>EIGMKGERRRGKGHDGLYQGLSTATKDTYDALHMQALPPR |
| 139101-nt Full CAR | 1002 | ATGGCCCTCCCTGTCACCGCCCTGCTGCTTCCGCTGGCTCTTCTGCTCCA<br>CGCCGCTCGGCCCCAAGTGCAACTTCAAGAATCAGGCGGAGGACTCGTGC<br>AGCCCGGAGGATCATTGCGGCTCTCGTGCGCCGCCTCGGGCTTCACCTTC<br>TCGAGCGACGCCATGACCTGGGTCCGCCAGGCCCCGGGGAAGGGGCTGGA<br>ATGGGTGTCTGTGATTTCCGGCTCCGGGGGAACTACGTACTACGCCGATT<br>CCGTGAAAGGTCGCTTCACTATCTCCCGGGACAACAGCAAGAACACCCTT<br>TATCTGCAAATGAATTCCCTCCGCGCCGAGGACACCGCCGTGTACTACTG<br>CGCCAAGCTGGACTCCTCGGGCTACTACTATGCCCGGGGTCCGAGATACT<br>GGGGACAGGGAACCCTCGTGACCGTGTCCTCCGCGTCCGGCGGAGGAGGG<br>TCGGGAGGGCGGGCCTCCGGCGGCGGCGGTTCGGACATCCAGCTGACCCA<br>GTCCCCATCCTCACTGAGCGCAAGCGTGGGCGACAGAGTCACCATTACAT<br>GCAGGGCGTCCCAGAGCATCAGCTCCTACCTGAACTGGTACCAACAGAAG<br>CCTGGAAAGGCTCCTAAGCTGTTGATCTACGGGCTTCGACCCTGGCATC<br>CGGGGTGCCCGCGAGGTTTAGCGGAAGCGGTAGCGGCACTCACTTCACTC<br>TGACCATTAACAGCCTCCAGTCCGAGGATTCAGCCACTTACTACTGTCAG<br>CAGTCCTACAAGCGGGCCAGCTTCGGACAGGGCACTAAGGTCGAGATCAA<br>GACCACTACCCCAGCACCGAGGCCACCCACCCCGGCTCCTACCATCGCCT<br>CCCAGCCTCTGTCCCTGCGTCCGGAGGCATGTAGACCCGCCAGCTGGTGGG<br>GCCGTGCATACCCGGGGTCTTGACTTCGCCTGCGATATCTACATTTGGGC<br>CCCTCTGGCTGGTACTTGCGGGGTCCTCTGCTGCTTTCACTCGTGATCACTC<br>TTTACTGTAAGCGCGGTCGGAAGAAGCTGCTGTACATCTTTAAGCAACCC<br>TTCATGAGGCCTGTGCAGACTACTCAAGAGGAGGACGGCTGTTCATGCCG<br>GTTCCCAGAGGAGGAGGAAGGCGGCTGCGAACTGCGCGTGAAATTCAGCC<br>GCAGCGCAGATGCTCCAGCCTACAAGCAGGGGCAGAACCAGCTCTACAAC<br>GAACTCAATCTTGGTCGGAGAGAGGAGTACGACGTGCTGGACAAGCGGAG<br>AGGACGGGACCCAGAAATGGGCGGGAAGCCGCGCAGAAAGAATCCCCAAG<br>AGGGCCTGTACAACGAGCTCCAAAAGGATAAGATGGCAGAAGCCTATAGC<br>GAGATTGGTATGAAAGGGGAACGCAGAAGAGGCAAAGGCCACGACGGACT<br>GTACCAGGGACTCAGCACCGCCACCAAGGACACCTATGACGCTCTTCACA<br>TGCAGGCCCTGCCGCCTCGG |
| | 139102 | |
| 139102-aa ScFv domain | 1003 | QVQLVQSGAEVKKPGASVKVSCKASGYTFSNYGITWVRQAPGQGLEWMGW<br>ISAYNGNTNYAQKFQGRVTMTRNTSISTAYMELSSLRSEDTAVYYCARGP<br>YYYYMDVWGKGTMVTVSSASGGGGSGGRASGGGGSEIVMTQSPLSLPVTP<br>GEPASISCRSSQSLLYSNGYNYVDWYLQKPGQSPQLLIYLGSNRASGVPD<br>RFSGSGSGTDFKLQISRVEAEDVGIYYCMQGRQFPYSFGQGTKVEIK |
| 139102-nt ScFv domain | 1004 | CAAGTCCAACTGGTCCAGAGCGGTGCAGAAGTGAAGAAGCCCGGAGCGAG<br>CGTGAAAGTGTCCTGCAAGGCTTCCGGGTACACCTTCTCCAACTACGGCA<br>TCACTTGGGTGCGCCAGGCCCCGGGACAGGGCCTGGAATGGATGGGGTGG<br>ATTTCCGCGTACAACGGCAATACGAACTACGCTCAGAAGTTCCAGGGTAG<br>AGTGACCATGACTAGGAACACCTCCATTTCCACCGCCTACATGGAACTGT<br>CCTCCCTGCGGAGCGAGGACACCGCCGTGTACTATTGCGCCCGGGGACCA<br>TACTACTACTACATGGATGTCTGGGGCAAGGGGACTATGGTCACCGTGTC<br>ATCCGCCTCGGGAGGCGGCGGATCAGGAGGACGCGCCTCTGGTGGTGGAG<br>GATCGGAGATCGTGATGACCCAGAGCCCTCTCTCCTTGCCCGTGACTCCT |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| | | GGGGAGCCCGCATCCATTTCATGCCGGAGCTCCCAGTCACTTCTCTACTC CAACGGCTATAACTACGTGGATTGGTACCTCCAAAAGCCGGGCCAGAGCC CGCAGCTGCTGATCTACCTGGGCTCGAACAGGGCCAGCGGAGTGCCTGAC CGGTTCTCCGGGTCGGGAAGCGGGACCGACTTCAAGCTGCAAATCTCGAG AGTGGAGGCCGAGGACGTGGGAATCTACTACTGTATGCAGGGCCGCCAGT TTCCGTACTCGTTCGGACAGGGCACCAAAGTGGAAATCAAG |
| 139102-aa VH | 1005 | QVQLVQSGAEVKKPGASVKVSCKASGYTFSNYGITWVRQAPGQGLEWMGW ISAYNGNTNYAQKFQGRVTMTRNTSISTAYMELSSLRSEDTAVYYCARGP YYYYMDVWGKGTMVTVSS |
| 139102-aa VL | 1006 | EIVMTQSPLSLPVTPGEPASISCRSSQSLLYSNGYNYVDWYLQKPGQSPQ LLIYLGSNRASGVPDRFSGSGSGTDFKLQISRVEAEDVGIYYCMQGRQFP YSFGQGTKVEIK |
| 139102-aa Full CAR | 1007 | MALPVTALLLPLALLLHAARPQVQLVQSGAEVKKPGASVKVSCKASGYTF SNYGITWVRQAPGQGLEWMGWISAYNGNTNYAQKFQGRVTMTRNTSISTA YMELSSLRSEDTAVYYCARGPYYYYMDVWGKGTMVTVSSASGGGGSGGRA SGGGGSEIVMTQSPLSLPVTPGEPASISCRSSQSLLYSNGYNYVDWYLQK PGQSPQLLIYLGSNRASGVPDRFSGSGSGTDFKLQISRVEAEDVGIYYCM QGRQFPYSFGQGTKVEIKTTTPAPRPPTPAPTIASQPLSLRPEACRPAAG GAVHTRGLDFACDIYIWAPLAGTCGVLLLSLVITLYCKRGRKKLLYIFKQ PFMRPVQTTQEEDGCSCRFPEEEEGGCELRVKFSRSADAPAYKQGQNQLY NELNLGRREEYDVLDKRRGRDPEMGGKPRRKNPQEGLYNELQKDKMAEAY SEIGMKGERRRGKGHDGLYQGLSTATKDTYDALHMQALPPR |
| 139102-nt Full CAR | 1008 | ATGGCCCTCCCTGTCACCGCCCTGCTGCTTCCGCTGGCTCTTCTGCTCCA CGCCGCTCGGCCCCAAGTCCAACTGGTCCAGAGCGGTGCAGAAGTGAAGA AGCCCGGAGCGAGCGTGAAAGTGTCCTGCAAGGCTTCCGGGTACACCTTC TCCAACTACGGCATCACTTGGGTGCGCCAGGCCCCGGGACAGGGCCTGGA ATGGATGGGGTGGATTTCCGCGTACAACGGCAATACGAACTACGCTCAGA AGTTCCAGGGTAGAGTGACCATGACTAGGAACACCTCCATTTCCACCGCC TACATGGAACTGTCCTCCCTGCGGAGCGAGGACACCGCCGTGTACTATTG CGCCCGGGGACCATACTACTACTACATGGATGTCTGGGGGAAGGGGACTA TGGTCACCGTGTCATCCGCCTCGGGAGGCGGCGGATCAGGAGGACGCGCC TCTGGTGGTGGAGGATCGGAGATCGTGATGACCCAGAGCCCTCTCTCCTT GCCCGTGACTCCTGGGGAGCCCGCATCCATTTCATGCCGGAGCTCCCAGT CACTTCTCTACTCCAACGGCTATAACTACGTGGATTGGTACCTCCAAAAG CCGGGCCAGAGCCCGCAGCTGCTGATCTACCTGGGCTCGAACAGGGCCAG CGGAGTGCCTGACCGGTTCTCCGGGTCGGGAAGCGGGACCGACTTCAAGC TGCAAATCTCGAGAGTGGAGGCCGAGGACGTGGGAATCTACTACTGTATG CAGGGCCGCCAGTTTCCGTACTCGTTCGGACAGGGCACCAAAGTGGAAAT CAAGACCACTACCCCAGCACCGAGGCCACCCACCCCGGCTCCTACCATCG CCTCCCAGCCTCTGTCCCTGCGTCCGGAGGCATGTAGACCCGCAGCTGGT GGGGCCGTGCATACCCGGGGTCTTGACTTCGCCTGCGATATCTACATTTG GGCCCCTCTGGCTGGTACTTGCGGGGTCCTGCTGCTTTCACTCGTGATCA CTCTTTACTGTAAGCGCGGTCGGAAGAAGCTGCTGTACATCTTTAAGCAA CCCTTCATGAGGCCTGTGCAGACTACTCAAGAGGAGGACGGCTGTTCATG CCGGTTCCCAGAGGAGGAGGAAGGCGGCTGCGAACTGCGCGTGAAATTCA GCCGCAGCGCAGATGCTCCAGCCTACAAGCAGGGGCAGAACCAGCTCTAC AACGAACTCAATCTTGGTCGGAGAGAGGAGTACGACGTGCTGGACAAGCG GAGAGGACGGGACCCAGAAATGGGCGGGAAGCCGCGCAGAAAGAATCCCC AAGAGGGCCTGTACAACGAGCTCCAAAAGGATAAGATGGCAGAAGCCTAT AGCGAGATTGGTATGAAAGGGAACGCAGAAGAGGCAAAGGCCACGACGG ACTGTACCAGGGACTCAGCACCGCCACCAAGGACACCTATGACGCTCTTC ACATGCAGGCCCTGCCGCCTCGG |

139104

| 139104-aa ScFv domain | 1009 | EVQLLETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSEIVLTQSPATLSVSPGES ATLSCRASQSVSSNLAWYQQKPGQAPRLLIYGASTRASGIPDRFSGSGSG TDFTLTISSLQAEDVAVYYCQQYGSSLTFGGGTKVEIK |
| 139104-nt ScFv domain | 1010 | GAAGTGCAATTGCTCGAAACTGGAGGAGGTCTGGTGCAACCTGGAGGATC ACTTCGCCTGTCCTGCGCCGTGTCGGGCTTTGCCCTGTCCAACCATGGAA TGAGCTGGGTCCGCCGCGCGCCGGGGAAGGGCCTCGAATGGGTGTCCGGC ATCGTCTACTCCGGCTCCACCTACTACGCCGCGTCCGTGAAGGGCCGGTT CACGGATTTCACGGGACAACTCGCGGAACACCCTGTACCTCCAAATGAATT CCCTTCGGCCGGAGGATACTGCCATCTACTACTGCTCCGCCCACGGTGGC GAATCCGACGTCTGGGGCCAGGGAACCACCGTGACCGTGTCCAGCGCGTC CGGGGGAGGAGGAAGCGGGGGTAGAGCATCGGGTGGAGGCGGATCAGAGA |

TABLE 5-continued

Amino Acid and Nucleic Acid Sequences of exemplary
anti-BCMA scFv domains and BCMA CAR molecules

| Name/Description | SEQ ID NO: | Sequence |
|---|---|---|
| | | TCGTGCTGACCCAGTCCCCCGCCACCTTGAGCGTGTCACCAGGAGAGTCC<br>GCCACCCTGTCATGCCGCGCCAGCCAGTCCGTGTCCTCCAACCTGGCTTG<br>GTACCAGCAGAAGCCGGGGCAGGCCCCTAGACTCCTGATCTATGGGGCGT<br>CGACCCGGGCATCTGGAATTCCCGATAGGTTCAGCGGATCGGGCTCGGGC<br>ACTGACTTCACTCTGACCATCTCCTGCTGCAAGCCGAGGACGTGGCTGT<br>GTACTACTGTCAGCAGTACGGAAGCTCCCTGACTTTCGGTGGCGGGACCA<br>AAGTCGAGATTAAG |
| 139104-aa VH | 1011 | EVQLLETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139104-aa VL | 1012 | EIVLTQSPATLSVSPGESATLSCRASQSVSSNLAWYQQKPGQAPRLLIYG<br>ASTRASGIPDRFSGSGSGTDFTLTISSLQAEDVAVYYCQQYGSSLTFGGG<br>TKVEIK |
| 139104-aa Full CAR | 1013 | MALPVTALLLPLALLLHAARPEVQLLETGGGLVQPGGSLRLSCAVSGFAL<br>SNHGMSWVRRAPGKGLEWVSGIVYSGSTYYAASVKGRFTISRDNSRNTLY<br>LQMNSLRPEDTAIYYCSAHGGESDVWGQGTTVTVSSASGGGGSGGRASGG<br>GGSEIVLTQSPATLSVSPGESATLSCRASQSVSSNLAWYQQKPGQAPRLL<br>IYGASTRASGIPDRFSGSGSGTDFTLTISSLQAEDVAVYYCQQYGSSLTF<br>GGGTKVEIKTTTPAPRPPTPAPTIASQPLSLRPEACRPAAGGAVHTRGLD<br>FACDIYIWAPLAGTCGVLLLSLVITLYCKRGRKKLLYIFKQPFMRPVQTT<br>QEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGER<br>RRGKGHDGLYQGLSTATKDTYDALHMQALPPR |
| 139104-nt Full CAR | 1014 | ATGGCCCTCCCTGTCACCGCCCTGCTGCTTCCGCTGGCTCTTCTGCTCCA<br>CGCCGCTCGGCCCGAAGTGCAATTGCTCGAAACTGGAGGAGGTCTGGTGC<br>AACCTGGAGGATCACTTCGCTGTCCTGCGCCGTGTCGGGCTTTGCCCTG<br>TCCAACCATGGAATGAGCTGGGTCCGCCGCGCGCCGGGGAAGGGCCTCGA<br>ATGGGTGTCCGGCATCGTCTACTCCGGCTCCACCTACTACGCCGCGTCCG<br>TGAAGGGCCGGTTCACGATTTCACGGGACAACTCGCGGAACACCCTGTAC<br>CTCCAAATGAATTCCCTTCGGCCGGAGGATACTGCCATCTACTACTGCTC<br>CGCCCACGGTGGCGAATCCGACGTCTGGGGCCAGGGAACCACCGTGACCG<br>TGTCCAGCGCGTCCGGGGAGGAGGAAGCGGGGGTAGAGCATCGGGTGGA<br>GGCGGATCAGAGATCGTGCTGACCCAGTCCCCCGCCACCTTGAGCGTGTC<br>ACCAGGAGAGTCCGCCACCCTGTCATGCCGCGCCAGCCAGTCCGTGTCCT<br>CCAACCTGGCTTGGTACCAGCAGAAGCCGGGGCAGGCCCCTAGACTCCTG<br>ATCTATGGGGCGTCGACCCGGGCATCTGGAATTCCCGATAGGTTCAGCGG<br>ATCGGGCTCGGGCACTGACTTCACTCTGACCATCTCCTGCTGCAAGCCG<br>AGGACGTGGCTGTGTACTACTGTCAGCAGTACGGAAGCTCCCTGACTTTC<br>GGTGGCGGGACCAAAGTCGAGATTAAGACCACTACCCCAGCACCGAGGCC<br>ACCCACCCCGGCTCCTACCATCGCCTCCCAGCCTCTGTCCCTGCGCTCCGG<br>AGGCATGTAGACCCGCAGCTGGTGGGGCCGTGCATACCCGGGGTCTTGAC<br>TTCGCCTGCGATATCTACATTTGGGCCCCTCTGGCTGGTACTTGCGGGGT<br>CCTGCTGCTTTCACTCGTGATCACTCTTTACTGTAAGCGCGGTCGGAAGA<br>AGCTGCTGTACATCTTTAAGCAACCCTTCATGAGGCCTGTGCAGACTACT<br>CAAGAGGAGGACGGCTGTTCATGCCGGTTCCCAGAGGAGGAGGAAGGCGG<br>CTGCGAACTGCGCGTGAAATTCAGCCGCAGCGCAGATGCTCCAGCCTACA<br>AGCAGGGGCAGAACCAGCTCTACAACGAACTCAATCTTGGTCGGAGAGAG<br>GAGTACGACGTGCTGGACAAGCGGAGGACGGGACCCAGAAATGGGCGG<br>GAAGCCGCGCAGAAAGAATCCCCAAGAGGGCCTGTACAACGAGCTCCAAA<br>AGGATAAGATGGCAGAAGCCTATAGCGAGATTGGTATGAAAGGGGAACGC<br>AGAAGAGGCAAAGGCCACGACGGACTGTACCAGGGACTCAGCACCGCCAC<br>CAAGGACACCTATGACGCTCTTCACATGCAGGCCCTGCCGCCTCGG |
| | 139106 | |
| 139106-aa ScFv domain | 1015 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSEIVMTQSPATLSVSPGER<br>ATLSCRASQSVSSKLAWYQQKPGQAPRLLMYGASIRATGIPDRFSGSGSG<br>TEFTLTISSLEPEDFAVYYCQQYGSSSWTFGQGTKVEIK |
| 139106-nt ScFv domain | 1016 | GAAGTGCAATTGGTGGAAACTGGAGGAGGACTTGTGCAACCTGGAGGATC<br>ATTGAGACTGAGCTGCGCAGTGTCGGGATTCGCCCTGAGCAACCATGGAA<br>TGTCCTGGGTCAGAAGGGCCCCTGGAAAAGGCCTCGAATGGGTGTCAGGG<br>ATCGTGTACTCCGGTTCCACTTACTACGCCGCCTCCGTGAAGGGGCGCTT<br>CACTATCTCACGGGATAACTCCCGCAATACCCTGTACCTCCAAATGAACA<br>GCCTGCGGCCGGAGGATACCGCCATCTACTACTGTTCCGCCCACGGTGGA<br>GAGTCTGACGTCTGGGGCCAGGGAACTACCGTGACCGTGTCCTCCGCGTC<br>CGGCGGTGGAGGGAGCGGCGGCCGCGCCAGCGGCGGCGGAGGCTCCGAGA |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | TCGTGATGACCCAGAGCCCCGCTACTCTGTCGGTGTCGCCCGGAGAAAGG<br>GCGACCCTGTCCTGCCGGGCGTCGCAGTCCGTGAGCAGCAAGCTGGCTTG<br>GTACCAGCAGAAGCCGGGCCAGGCACCACGCCTGCTTATGTACGGTGCCT<br>CCATTCGGGCCACCGGAATCCCGGACCGGTTCTCGGGGTCGGGGTCCGGT<br>ACCGAGTTCACACTGACCATTTCCTCGCTCGAGCCCGAGGACTTTGCCGT<br>CTATTACTGCCAGCAGTACGGCTCCTCCTCATGGACGTTCGGCCAGGGGA<br>CCAAGGTCGAAATCAAG |
| 139106-aa<br>VH | 1017 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139106-aa<br>VL | 1018 | EIVMTQSPATLSVSPGERATLSCRASQSVSSKLAWYQQKPGQAPRLLMYG<br>ASIRATGIPDRFSGSGSGTEFTLTISSLEPEDFAVYYCQQYGSSSWTFGQ<br>GTKVEIK |
| 139106-aa<br>Full CAR | 1019 | MALPVTALLLPLALLLHAARPEVQLVETGGGLVQPGGSLRLSCAVSGFAL<br>SNHGMSWVRRAPGKGLEWVSGIVYSGSTYYAASVKGRFTISRDNSRNTLY<br>LQMNSLRPEDTAIYYCSAHGGESDVWGQGTTVTVSSASGGGGSGGRASGG<br>GGSEIVMTQSPATLSVSPGERATLSCRASQSVSSKLAWYQQKPGQAPRLL<br>MYGASIRATGIPDRFSGSGSGTEFTLTISSLEPEDFAVYYCQQYGSSSWT<br>FGQGTKVEIKTTTPAPRPPTPAPTIASQPLSLRPEACRPAAGGAVHTRGL<br>DFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRR<br>EEYDVLDKRRGRDPEMGGKPRRKNPQEGLYNELQKDKMAEAYSEIGMKGE<br>RRRGKGHDGLYQGLSTATKDTYDALHMQALPPR |
| 139106-nt<br>Full CAR | 1020 | ATGGCCCTCCCTGTCACCGCCCTGCTGCTTCCGCTGGCTCTTCTGCTCCA<br>CGCCGCTCGGCCCGAAGTGCAATTGGTGGAAACTGGAGGAGGACTTGTGC<br>AACCTGGAGGATCATTGAGACTGAGCTGCGCAGTGTCGGGATTCGCCCTG<br>AGCAACCATGGAATGTCCTGGGTCAGAAGGGCCCCTGGAAAAGGCCTCGA<br>ATGGGTGTCAGGGATCGTGTACTCCGGTTCCACTTACTACGCCGCCTCCG<br>TGAAGGGGCGCTTCACTATCTCACGGGATAACTCCCGCAATACCCTGTAC<br>CTCCAAATGAACAGCCTGCGGCCGGAGGATACCGCCATCTACTACTGTTC<br>CGCCCACGGTGGAGAGTCTGACGTCTGGGGCCAGGGAACTACCGTGACCG<br>TGTCCTCCGCGTCCGGCGGTGGAGGGAGCGGCGGCCGCGCCAGCGGCGGC<br>GGAGGCTCCGAGATCGTGATGACCCAGAGCCCCGCTACTCTGTCGGTGTC<br>GCCCGGAGAAAGGGCGACCCTGTCCTGCCGGGCGTCGCAGTCCGTGAGCA<br>GCAAGCTGGCTTGGTACCAGCAGAAGCCGGGCCAGGCACCACGCCTGCTT<br>ATGTACGGTGCCTCCATTCGGGCCACCGGAATCCCGGACCGGTTCTCGGG<br>GTCGGGGTCCGGTACCGAGTTCACACTGACCATTTCCTCGCTCGAGCCCG<br>AGGACTTTGCCGTCTATTACTGCCAGCAGTACGGCTCCTCCTCATGGACG<br>TTCGGCCAGGGGACCAAGGTCGAAATCAAGACCACTACCCCAGCACCGAG<br>GCCACCCACCCCGGCTCCTACCATCGCCTCCCAGCCTCTGTCCCTGCGTC<br>CGGAGGCATGTAGACCCGCAGCTGGTGGGCCGTGCATACCCGGGGTCTT<br>GACTTCGCCTGCGATATCTACATTTGGGCCCCTCTGGCTGGTACTTGCGG<br>GGTCCTGCTGCTTTCACTCGTGATCACTCTTTTACTGTAAGCGCGGTCGGA<br>AGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGG<br>CGGCTGCGAACTGCGCGTGAAATTCAGCCGCAGCGCAGATGCTCCAGCCT<br>ACAAGCAGGGGCAGAACCAGCTCTACAACGAACTCAATCTTGGTCGGAGA<br>GAGGAGTACGACGTGCTGGACAAGCGGAGAGGACGGGACCCAGAAATGGG<br>CGGGAAGCCGCGCAGAAAGAATCCCCAAGAGGGCCTGTACAACGAGCTCC<br>AAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGC<br>CACCAAGGACACCTATGACGCTCTTCACATGCAGGCCCTGCCGCCTCGG |
| | | 139107 |
| 139107-aa<br>ScFv domain | 1021 | EVQLVETGGGVVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSEIVLTQSPGTLSLSPGER<br>ATLSCRASQSVGSTNLAWYQQKPGQAPRLLIYDASNRATGIPDRFSGGGS<br>GTDFTLTISRLEPEDFAVYYCQQYGSSPPWTFGQGTKVEIK |
| 139107-nt<br>ScFv domain | 1022 | GAAGTGCAATTGGTGGAGACTGGAGGAGGAGTGGTGCAACCTGGAGGAAG<br>CCTGAGACTGTCATGCGCGGTGTCGGGCTTCGCCCTCTCCAACCACGGAA<br>TGTCCTGGGTCCGCCGGGCCCCTGGGAAAGGACTTGAATGGGTGTCCGGC<br>ATCGTGTACTCGGGTTCCACTTACTACGCGGCCTCAGTGAAGGGCCGGTT<br>TACTATTAGCCGCGACAACTCCAGAAACACACTGTACCTCCAAATGAACT<br>CGCTGCGGCCGGAAGATACCGCTATCTACTACTGCTCCGCCCATGGGGGA<br>GAGTCGGACGTCTGGGGACAGGGCACCACTGTCACTGTGTCCAGCGCTTC<br>CGGCGGTGGTGGAAGCGGGGGACGGGCCTCAGGAGGCGGTGGCAGCGAGA |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | TTGTGCTGACCCAGTCCCCCGGGACCCTGAGCCTGTCCCCGGGAGAAAGG<br>GCCACCCTCTCCTGTCGGGCATCCCAGTCCGTGGGGTCTACTAACCTTGC<br>ATGGTACCAGCAGAAGCCCGGCCAGGCCCCTCGCCTGCTGATCTACGACG<br>CGTCCAATAGAGCCACCGGCATCCCGGATCGCTTCAGCGGAGGCGGATCG<br>GGCACCGACTTCACCCTCACCATTTCAAGGCTGGAACCGGAGGACTTCGC<br>CGTGTACTACTGCCAGCAGTATGGTTCGTCCCCACCCTGGACGTTCGGCC<br>AGGGGACTAAGGTCGAGATCAAG |
| 139107-aa<br>VH | 1023 | EVQLVETGGGVVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139107-aa<br>VL | 1024 | EIVLTQSPGTLSLSPGERATLSCRASQSVGSTNLAWYQQKPGQAPRLLIY<br>DASNRATGIPDRFSGGGSGTDFTLTISRLEPEDFAVYYCQQYGSSPPWTF<br>GQGTKVEIK |
| 139107-aa<br>Full CAR | 1025 | MALPVTALLLPLALLLHAARPEVQLVETGGGVVQPGGSLRLSCAVSGFAL<br>SNHGMSWVRRAPGKGLEWVSGIVYSGSTYYAASVKGRFTISRDNSRNTLY<br>LQMNSLRPEDTAIYYCSAHGGESDVWGQGTTVTVSSASGGGGSGGRASGG<br>GGSEIVLTQSPGTLSLSPGERATLSCRASQSVGSTNLAWYQQKPGQAPRL<br>LIYDASNRATGIPDRFSGGGSGTDFTLTISRLEPEDFAVYYCQQYGSSPP<br>WTFGQGTKVEIKTTTPAPRPPTPAPTIASQPLSLRPEACRPAAGGAVHTR<br>GLDFACDIYIWAPLAGTCGVLLLSLVITLYCKRGRKKLLYIFKQPFMRPV<br>QTTQEEDGCSCRFPEEEEGGCELRVKFSRSADAPAYKQGQNQLYNELNLG<br>RREEYDVLDKRRGRDPEMGGKPRRKNPQEGLYNELQKDKMAEAYSEIGMK<br>GERRRGKGHDGLYQGLSTATKDTYDALHMQALPPR |
| 139107-nt<br>Full CAR | 1026 | ATGGCCCTCCCTGTCACCGCCCTGCTGCTTCCGCTGGCTCTTCTGCTCCA<br>CGCCGCTCGGCCCGAAGTGCAATTGGTGGAGACTGGAGGAGGAGTGGTGC<br>AACCTGGAGGAAGCCTGAGACTGTCATGCGCGGTGTCGGGCTTCGCCCTC<br>TCCAACCACGGAATGTCCTGGGTCCGCCGGGCCCCTGGGAAAGGACTTGA<br>ATGGGTGTCCGGCATCGTGTACTCGGGTTCCACCTACTACGCGGCCTCAG<br>TGAAGGGCCGGTTTACTATTAGCCGCGACAACTCCAGAAACACACTGTAC<br>CTCCAAATGAACTCGCTGCGGCCGGAAGATACCGCTATCTACTACTGCTC<br>CGCCCATGGGGAGAGTCGGACGTCTGGGGACAGGGCACCACTGTCACTG<br>TGTCCAGCGCTTCCGGCGGTGGTGGAAGCGGGGGACGGGCCTCAGGAGGC<br>GGTGGCAGCGAGATTGTGCTGACCCAGTCCCCCGGGACCCTGAGCCTGTC<br>CCCGGGAGAAAGGGCCACCCTCTCCTGTCGGGCATCCCAGTCCGTGGGGT<br>CTACTAACCTTGCATGGTACCAGCAGAAGCCCGGCCAGGCCCCTCGCCTG<br>CTGATCTACGACGCGTCCAATAGAGCCACCGGCATCCCGGATCGCTTCAG<br>CGGAGGCGGATCGGGCACCGACTTCACCCTCACCATTTCAAGGCTGGAAC<br>CGGAGGACTTCGCCGTGTACTACTGCCAGCAGTATGGTTCGTCCCCACCC<br>TGGACGTTCGGCCAGGGGACTAAGGTCGAGATCAAGACCACTACCCCAGC<br>ACCGAGGCCACCCACCCCGGCTCCTACCATCGCCTCCCAGCCTCTGTCCC<br>TGCGTCCGGAGGCATGTAGACCCGCAGCTGGTGGGGCCGTGCATACCCGG<br>GGTCTTGACTTCGCCTGCGATATCTACATTTGGGCCCCTCTGGCTGGTAC<br>TTGCGGGGTCCTGCTGCTTTCACTCGTGATCACTCTTTACTGTAAGCGCG<br>GTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGA<br>GGAAGGCGGCTGCGAACTGCGCGTGAAATTCAGCCGCAGCGCAGATGCTC<br>CAGCCTACAAGCAGGGGCAGAACCAGCTCTACAACGAACTCAATCTTGGT<br>CGGAGAGAGGAGTACGACGTGCTGGACAAGCGGAGAGGACGGGACCCAGA<br>AATGGGCGGGAAGCCGCGCAGAAAGAATCCCCAAGAGGGCCTGTACAACG<br>AGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAG<br>CACCGCCACCAAGGACACCTATGACGCTCTTCACATGCAGGCCCTGCCGC<br>CTCGG |

139108

| 139108-aa<br>ScFv domain | 1027 | QVQLVESGGGLVKPGGSLRLSCAASGFTFSDYYMSWIRQAPGKGLEWVSY<br>ISSSGSTIYYADSVKGRFTISRDNAKNSLYLQMNSLRAEDTAVYYCARES<br>GDGMDVWGQGTTVTVSSASGGGGSGGRASGGGGSDIQMTQSPSSLSASVG<br>DRVTITCRASQSISSYLNWYQQKPGKAPKLLIYAASSLQSGVPSRFSGSG<br>SGTDFTLTISSLQPEDFATYYCQQSYTLAFGQGTKVDIK |
| 139108-nt<br>ScFv domain | 1028 | CAAGTGCAACTCGTGGAATCTGGTGGAGGACTCGTGAAACCTGGAGGATC<br>ATTGAGACTGTCATGCGCGGCCTCGGGATTCACGTTCTCCGATTACTACA<br>TGAGCTGGATTCGCCAGGCTCCGGGGAAGGGACTGGAATGGGTGTCCTAC<br>ATTTCCTCATCCGGCTCCACCATCTACTACGCGGACTCCGTGAAGGGGAG<br>ATTCACCATTAGCCGCGATAACGCCAAGAACAGCCTGTACCTTCAGATGA<br>ACTCCCTGCGGGCTGAAGATACTGCCGTCTACTACTGCGCAAGGGAGAGC<br>GGAGATGGGATGGACGTCTGGGGACAGGGTACCACTGTGACCGTGTCGTC |

TABLE 5-continued

Amino Acid and Nucleic Acid Sequences of exemplary anti-BCMA scFv domains and BCMA CAR molecules

| Name/ Description | SEQ ID NO: | Sequence |
|---|---|---|
| | | GGCCTCCGGCGGAGGGGGTTCGGGTGGAAGGGCCAGCGGCGGCGGAGGCA GCGACATCCAGATGACCCAGTCCCCCTCATCGCTGTCCGCCTCCGTGGGC GACCGCGTCACCATCACATGCCGGGCCTCACAGTCGATCTCCTCCTACCT CAATTGGTATCAGCAGAAGCCCGGAAAGGCCCCTAAGCTTCTGATCTACG CAGCGTCCTCCCTGCAATCCGGGGTCCCATCTCGGTTCTCCGGCTCGGGC AGCGGTACCGACTTCACTCTGACCATCTCGAGCCTGCAGCCGGAGGACTT CGCCACTTACTACTGTCAGCAAAGCTACACCCTCGCGTTTGGCCAGGGCA CCAAAGTGGACATCAAG |
| 139108-aa VH | 1029 | QVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARES GDGMDVWGQGTTVTVSS |
| 139108-aa VL | 1030 | DIQMTQSPSSLSASVGDRVTITCRASQSISSYLNWYQQKPGKAPKLLIYA ASSLQSGVPSRFSGSGSGTDFTLTISSLQPEDFATYYCQQSYTLAFGQGT KVDIK |
| 139108-aa Full CAR | 1031 | MALPVTALLLPLALLLHAARPQVQLVESGGGLVKPGGSLRLSCAASGFTF SDYYMSWIRQAPGKGLEWVSYISSSGSTIYYADSVKGRFTISRDNAKNSL YLQMNSLRAEDTAVYYCARESGDGMDVWGQGTTVTVSSASGGGGSGGRAS GGGGSDIQMTQSPSSLSASVGDRVTITCRASQSISSYLNWYQQKPGKAPK LLIYAASSLQSGVPSRFSGSGSGTDFTLTISSLQPEDFATYYCQQSYTLA FGQGTKVDIKTTTPAPRPPTPAPTIASQPLSLRPEACRPAAGGAVHTRGL DFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRR EEYDVLDKRRGRDPEMGGKPRRKNPQEGLYNELQKDKMAEAYSEIGMKGE RRRGKGHDGLYQGLSTATKDTYDALHMQALPPR |
| 139108-nt Full CAR | 1032 | ATGGCCCTCCCTGTCACCGCCCTGCTGCTTCCGCTGGCTCTTCTGCTCCA CGCCGCTCGGCCCCAAGTGCAACTCGTGGAATCTGGTGGAGGACTCGTGA AACCTGGAGGATCATTGAGACTGTCATGCGCGGCCTCGGGATTCACGTTC TCCGATTACTACATGAGCTGGATTCGCCAGGCTCCGGGGAAGGGACTGGA ATGGGTGTCCTACATTTCCTCATCCGGCTCCACCATCTACTACGCGGACT CCGTGAAGGGGAGATTCACCATTAGCCGCGATAACGCCAAGAACAGCCTG TACCTTCAGATGAACTCCCTGCGGGCTGAAGATACTGCCGTCTACTACTG CGCAAGGGAGAGCGGAGATGGGATGGACGTCTGGGGACAGGGTACCACTG TGACCGTGTCGTCGGCCTCCGGCGGAGGGGGTTCGGGTGGAAGGGCCAGC GGCGGCGGAGGCAGCGACATCCAGATGACCCAGTCCCCCTCATCGCTGTC CGCCTCCGTGGGCGACCGCGTCACCATCACATGCCGGGCCTCACAGTCGA TCTCCTCCTACCTCAATTGGTATCAGCAGAAGCCCGGAAAGGCCCCTAAG CTTCTGATCTACGCAGCGTCCTCCCTGCAATCCGGGGTCCCATCTCGGTT CTCCGGCTCGGGCAGCGGTACCGACTTCACTCTGACCATCTCGAGCCTGC AGCCGGAGGACTTCGCCACTTACTACTGTCAGCAAAGCTACACCCTCGCG TTTGGCCAGGGCACCAAAGTGGACATCAAGACCACTACCCCAGCACCGAG GCCACCCACCCCGGCTCCTACCATCGCCTCCCAGCCTCTGTCCCTGCGTC CGGAGGCATGTAGACCCGCAGCTGGTGGGCCGTGCATACCCGGGGTCTT GACTTCGCCTGCGATATCTACATTTGGGCCCCTCTGGCTGGTACTTGCGG GGTCCTGCTGCTTTCACTCGTGATCACTCTTTACTGTAAGCGCGGTCGGA AGAAGCTGCTGTACATCTTTAAGCAACCCTTCATGAGGCCTGTGCAGACT ACTCAAGAGGAGGACGGCTGTTCATGCCGGTTCCCAGAGGAGGAGGAAGG CGGCTGCGAACTGCGCGTGAAATTCAGCCGCAGCGCAGATGCTCCAGCCT ACAAGCAGGGGCAGAACCAGCTCTACAACGAACTCAATCTTGGTCGGAGA GAGGAGTACGACGTGCTGGACAAGCGGAGAGGACGGGACCCAGAAATGGG CGGGAAGCCGCGCAGAAAGAATCCCCAAGAGGGCCTGTACAACGAGCTCC AAAAGGATAAGATGGCAGAAGCCTATAGCGAGATTGGTATGAAAGGGGAA CGCAGAAGAGGCAAAGGCCACGACGGACTGTACCAGGGACTCAGCACCGC CACCAAGGACACCTATGACGCTCTTCACATGCAGGCCCTGCCGCCTCGG |

139110

| 139110-aa ScFv domain | 1033 | QVQLVQSGGGLVKPGGSLRLSCAASGFTFSDYYMSWIRQAPGKGLEWVSY ISSSGNTIYYADSVKGRFTISRDNAKNSLYLQMNSLRAEDTAVYYCARST MVREDYWGQGTLVTVSSASGGGGSGGRASGGGGSDIVLTQSPLSLPVTLG QPASISCKSSESLVHNSGKTYLNWFHQRPGQSPRRLIYEVSNRDSGVPDR FTGSGSGTDFTLKISRVEAEDVGVYYCMQGTHWPGTFGQGTKLEIK |
| 139110-nt ScFv domain | 1034 | CAAGTGCAACTGGTGCAAAGCGGAGGAGGATTGGTCAAACCCGGAGGAAG CCTGAGACTGTCATGCGCGGCCTCTGGATTCACCTTCTCCGATTACTACA TGTCATGGATCAGACAGGCCCCGGGGAAGGGCCTCGAATGGGTGTCCTAC ATCTCGTCCTCCGGGAACACCATCTACTACGCCGACAGCGTGAAGGGCCG CTTTACCATTTCCCGCGACAACGCAAAGAACTCGCTGTACCTTCAGATGA ATTCCCTGCGGGCTGAAGATACCGCGGTGTACTATTGCGCCCGGTCCACT ATGGTCCGGGAGGACTACTGGGGACAGGGCACACTCGTGACCGTGTCCAG |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | CGCGAGCGGGGTGGAGGCAGCGGTGGACGCGCCTCCGGCGGCGGCGGTT<br>CAGACATCGTGCTGACTCAGTCGCCCCTGTCGCTGCCGGTCACCCTGGGC<br>CAACCGGCCTCAATTAGCTGCAAGTCCTCGGAGAGCCTGGTGCACAACTC<br>AGGAAAGACTTACCTGAACTGGTTCCATCAGCGGCCTGGACAGTCCCCAC<br>GGAGGCTCATCTATGAAGTGTCCAACAGGGATTCGGGGGTGCCCGACCGC<br>TTCACTGGCTCCGGGTCCGGCACCGACTTCACCTTGAAAATCTCCAGAGT<br>GGAAGCCGAGGACGTGGGCGTGTACTACTGTATGCAGGGTACCCACTGGC<br>CTGGAACCTTTGGACAAGGAACTAAGCTCGAGATTAAG |
| 139110-aa<br>VH | 1035 | QVQLVQSGGGLVKPGGSLRLSCAASGFTFSDYYMSWIRQAPGKGLEWVSY<br>ISSSGNTIYYADSVKGRFTISRDNAKNSLYLQMNSLRAEDTAVYYCARST<br>MVREDYWGQGTLVTVSS |
| 139110-aa<br>VL | 1036 | DIVLTQSPLSLPVTLGQPASISCKSSESLVHNSGKTYLNWFHQRPGQSPR<br>RLIYEVSNRDSGVPDRFTGSGSGTDFTLKISRVEAEDVGVYYCMQGTHWP<br>GTFGQGTKLEIK |
| 139110-aa<br>Full CAR | 1037 | MALPVTALLLPLALLLHAARPQVQLVQSGGGLVKPGGSLRLSCAASGFTF<br>SDYYMSWIRQAPGKGLEWVSYISSSGNTIYYADSVKGRFTISRDNAKNSL<br>YLQMNSLRAEDTAVYYCARSTMVREDYWGQGTLVTVSSASGGGGSGGRAS<br>GGGGSDIVLTQSPLSLPVTLGQPASISCKSSESLVHNSGKTYLNWFHQRP<br>GQSPRRLIYEVSNRDSGVPDRFTGSGSGTDFTLKISRVEAEDVGVYYCMQ<br>GTHWPGTFGQGTKLEIKTTTPAPRPPTPAPTIASQPLSLRPEACRPAAGG<br>AVHTRGLDFACDIYIWAPLAGTCGVLLLSLVITLYCKRGRKKLLYIFKQP<br>FMRPVQTTQEEDGCSCRFPEEEEGGCELRVKFSRSADAPAYKQGQNQLYN<br>ELNLGRREEYDVLDKRRGRDPEMGGKPRRKNPQEGLYNELQKDKMAEAYS<br>EIGMKGERRRGKGHDGLYQGLSTATKDTYDALHMQALPPR |
| 139110-nt<br>Full CAR | 1038 | ATGGCCCTCCCTGTCACCGCCCTGCTGCTTCCGCTGGCTCTTCTGCTCCA<br>CGCCGCTCGGCCCCAAGTGCAACTGGTGCAAAGCGGAGGAGGATTGGTCA<br>AACCCGGAGGAAGCCTGAGACTGTCATGCGCGGCCTCTGGATTCACCTTC<br>TCCGATTACTACATGTCATGGATCAGACAGGCCCCGGGGAAGGGCCTCGA<br>ATGGGTGTCCTACATCTCGTCCTCCGGGAACACCATCTACTACGCCGACA<br>GCGTGAAGGGCCGCTTTACCATTTCCCGCGACAACGCAAAGAACTCGCTG<br>TACCTTCAGATGAATTCCCTGCGGGCTGAAGATACCGCGGTGTACTATTG<br>CGCCCGGTCCACTATGGTCCGGGAGGACTACTGGGGACAGGGCACACTCG<br>TGACCGTGTCCAGCGCGAGCGGGGGTGGAGGCAGCGGTGGACGCGCCTCC<br>GGCGGCGGCGGTTCAGACATCGTGCTGACTCAGTCGCCCCTGTCGCTGCC<br>GGTCACCCTGGGCCAACCGGCCTCAATTAGCTGCAAGTCCTCGGAGAGCC<br>TGGTGCACAACTCAGGAAAGACTTACCTGAACTGGTTCCATCAGCGGCCT<br>GGACAGTCCCCACGGAGGCTCATCTATGAAGTGTCCAACAGGGATTCGGG<br>GGTGCCCGACCGCTTCACTGGCTCCGGGTCCGGCACCGACTTCACCTTGA<br>AAATCTCCAGAGTGGAAGCCGAGGACGTGGGCGTGTACTACTGTATGCAG<br>GGTACCCACTGGCCTGGAACCTTTGGACAAGGAACTAAGCTCGAGATTAA<br>GACCACTACCCCAGCACCGAGGCCACCCACCCCGGCTCCTACCATCGCCT<br>CCCAGCCTCTGTCCCTGCGTCCGGAGGCATGTAGACCCGCAGCTGGTGGG<br>GCCGTGCATACCCGGGGTCTTGACTTCGCCTGCGATATCTACATTTGGGC<br>CCCTCTGGCTGGTACTTGCGGGGTCCTGCTGCTTTCACTCGTGATCACTC<br>TTTACTGTAAGCGCGGTCGGAAGAAGCTGCTGTACATCTTTAAGCAACCC<br>TTCATGAGGCCTGTGCAGACTACTCAAGAGGAGGACGGCTGTTCATGCCG<br>GTTCCCAGAGGAGGAGGAAGGCGGCTGCGAACTGCGCGTGAAATTCAGCC<br>GCAGCGCAGATGCTCCAGCCTACAAGCAGGGGCAGAACCAGCTCTACAAC<br>GAACTCAATCTTGGTCGGAGAGAGGAGTACGACGTGCTGGACAAGCGGAG<br>AGGACGGGACCCAGAAATGGGCGGGAAGCCGCGCAGAAAGAATCCCCAAG<br>AGGGCCTGTACAACGAGCTCCAAAAGGATAAGATGGCAGAAGCCTATAGC<br>GAGATTGGTATGAAAGGGGAACGCAGAAGAGGCAAAGGCCACGACGGACT<br>GTACCAGGGACTCAGCACCGCCACCAAGGACACCTATGACGCTCTTCACA<br>TGCAGGCCCTGCCGCCTCGG |

139112

| 139112-aa<br>ScFv domain | 1039 | QVQLVESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSDIRLTQSPSPLSASVGDR<br>VTITCQASEDINKFLNWYHQTPGKAPKLLIYDASTLQTGVPSRFSGSGSG<br>TDFTLTINSLQPEDIGTYYCQQYESLPLTFGGGTKVEIK |
| 139112-nt<br>ScFv domain | 1040 | CAAGTGCAACTCGTGGAATCTGGTGGAGGACTCGTGCAACCCGGTGGAAG<br>CCTTAGGCTGTCGTGCGCCGTCAGCGGGTTTGCTCTGAGCAACCATGGAA<br>TGTCCTGGGTCCGCCGGGCACCGGGAAAGGGCTGGAATGGGTGTCCGGC<br>ATCGTGTACAGCGGGTCAACCTATTACGCCGCGTCCGTGAAGGGCAGATT<br>CACTATCTCAAGAGACAACAGCCGGAACACCCTGTACTTGCAAATGAATT<br>CCCTGCGCCCCGAGGACACCGCCATCTACTACTGCTCCGCCCACGGAGGA |

TABLE 5-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
| | | GAGTCGGACGTGTGGGGCCAGGGAACGACTGTGACTGTGTCCAGCGCATC<br>AGGAGGGGGTGGTTCGGCGGCCGGGCCTCGGGGGAGGAGGTTCCGACA<br>TTCGGCTGACCCAGTCCCCGTCCCCACTGTCGGCCTCCGTCGGCGACCGC<br>GTGACCATCACTTGTCAGGCGTCCGAGGACATTAACAAGTTCCTGAACTG<br>GTACCACCAGACCCCTGGAAAGGCCCCCAAGCTGCTGATCTACGATGCCT<br>CGACCCTTCAAACTGGAGTGCCTAGCCGGTTCTCCGGGTCCGGCTCCGGC<br>ACTGATTTCACTCTGACCATCAACTCATTGCAGCCGGAAGATATCGGGAC<br>CTACTATTGCCAGCAGTACGAATCCCTCCCGCTCACATTCGGCGGGGGAA<br>CCAAGGTCGAGATTAAG |
| 139112-aa<br>VH | 1041 | QVQLVESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139112-aa<br>VL | 1042 | DIRLTQSPSPLSASVGDRVTITCQASEDINKFLNWYHQTPGKAPKLLIYD<br>ASTLQTGVPSRFSGSGSGTDFTLTINSLQPEDIGTYYCQQYESLPLTFGG<br>GTKVEIK |
| 139112-aa<br>Full CAR | 1043 | MALPVTALLLPLALLLHAARPQVQLVESGGGLVQPGGSLRLSCAVSGFAL<br>SNHGMSWVRRAPGKGLEWVSGIVYSGSTYYAASVKGRFTISRDNSRNTLY<br>LQMNSLRPEDTAIYYCSAHGGESDVWGQGTTVTVSSASGGGGSGGGRASGG<br>GGSDIRLTQSPSPLSASVGDRVTITCQASEDINKFLNWYHQTPGKAPKLL<br>IYDASTLQTGVPSRFSGSGSGTDFTLTINSLQPEDIGTYYCQQYESLPLT<br>FGGGTKVEIKTTTPAPRPPTPAPTIASQPLSLRPEACRPAAGGAVHTRGL<br>DFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRR<br>EEYDVLDKRRGRDPEMGGKPRRKNPQEGLYNELQKDKMAEAYSEIGMKGE<br>RRRGKGHDGLYQGLSTATKDTYDALHMQALPPR |
| 139112-nt<br>Full CAR | 1044 | ATGGCCCTCCCTGTCACCGCCCTGCTGCTTCCGCTGGCTCTTCTGCTCCA<br>CGCCGCTCGGCCCCAAGTGCAACTCGTGGAATCTGGTGGAGGACTCGTGC<br>AACCCGGTGGAAGCCTTAGGCTGTCGTGCGCCGTCAGCGGGTTTGCTCTG<br>AGCAACCATGGAATGTCCTGGGTCCGCCGGGCACCGGGAAAAGGGCTGGA<br>ATGGGTGTCCGGCATCGTGTACAGCGGGTCAACCTATTACGCCGCGTCCG<br>TGAAGGGCAGATTCACTATCTCAAGAGACAACAGCCGGAACACCCTGTAC<br>TTGCAAATGAATTCCCTGCGCCCCGAGGACACCGCCATCTACTACTGCTC<br>CGCCCACGGAGGAGAGTCGGACGTGTGGGGCCAGGGAACGACTGTGACTG<br>TGTCCAGCGCATCAGGAGGGGTGGTTCGGCGGCCGGGCCTCGGGGGA<br>GGAGGTTCCGACATTCGGCTGACCCAGTCCCCGTCCCCACTGTCGGCCTC<br>CGTCGGCGACCGCGTGACCATCACTTGTCAGGCGTCCGAGGACATTAACA<br>AGTTCCTGAACTGGTACCACCAGACCCCTGGAAAGGCCCCCAAGCTGCTG<br>ATCTACGATGCCTCGACCCTTCAAACTGGAGTGCCTAGCCGGTTCTCCGG<br>GTCCGGCTCCGGCACTGATTTCACTCTGACCATCAACTCATTGCAGCCGG<br>AAGATATCGGGACCTACTATTGCCAGCAGTACGAATCCCTCCCGCTCACA<br>TTCGGCGGGGGAACCAAGGTCGAGATTAAGACCACTACCCCAGCACCGAG<br>GCCACCCACCCCGGCTCCTACCATCGCCTCCCAGCCTCTGTCCCTGCGTC<br>CGGAGGCATGTAGACCCGCAGCTGGTGGGGCCGTGCATACCCGGGGTCTT<br>GACTTCGCCTGCGATATCTACATTTGGGCCCCTCTGGCTGGTACTTGCGG<br>GGTCCTGCTGCTTTCACTCGTGATCACTCTTTACTGTAAGCGCGGTCGGA<br>AGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGG<br>CGGCTGCGAACTGCGCGTGAAATTCAGCCGCAGCGCAGATGCTCCAGCCT<br>ACAAGCAGGGGCAGAACCAGCTCTACAACGAACTCAATCTTGGTCGGAGA<br>GAGGAGTACGACGTGCTGGACAAGCGGAGAGGACGGGACCCAGAAATGGG<br>CGGGAAGCCGCGCAGAAAGAATCCCCAAGAGGGCCTGTACAACGAGCTCC<br>AAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGC<br>CACCAAGGACACCTATGACGCTCTTCACATGCAGGCCCTGCCGCCTCGG |

139113

| 139113-aa<br>ScFv domain | 1045 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGSETTLTQSPATLSVSPGER<br>ATLSCRASQSVGSNLAWYQQKPGQPRLLIYGASTRATGIPARFSGSGSG<br>TEFTLTISSLQPEDFAVYYCQQYNDWLPVTFGQGTKVEIK |
| 139113-nt<br>ScFv domain | 1046 | GAAGTGCAATTGGTGGAAACTGGAGGAGGACTTGTGCAACCTGGAGGATC<br>ATTGCGGCTCTCATGCGCTGTCTCCGGCTTCGCCCTGTCAAATCACGGGA<br>TGTCGTGGGTCAGACGGGCCCCGGGAAAGGGTCTGGAATGGGTGTCGGGG<br>ATTGTGTACAGCGGCTCCACCTACTACGCCGCTTCGGTCAAGGGCCGCTT<br>CACTATTTCACGGGACAACAGCCGCAACACCCTCTATCTGCAAATGAACT<br>CTCTCCGCCCGGAGGATACCGCCATCTACTACTGCTCCGCACACGGCGGC |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| | | GAATCCGACGTGTGGGGACAGGGAACCACTGTCACCGTGTCGTCCGCATC CGGTGGCGGAGGATCGGGTGGCCGGGCCTCCGGGGCGGCGGCAGCGAGA CTACCCTGACCCAGTCCCCTGCCACTCTGTCCGTGAGCCCGGGAGAGAGA GCCACCCTTAGCTGCCGGGCCAGCCAGAGCGTGGGCTCCAACCTGGCCTG GTACCAGCAGAAGCCAGGACAGGGTCCCAGGCTGCTGATCTACGGAGCCT CCACTCGCGCGACCGGCATCCCCGCGAGGTTCTCCGGGTCGGGTTCCGGG ACCGAGTTCACCCTGACCATCTCCTCCCTCCAACCGGAGGACTTCGCGGT GTACTACTGTCAGCAGTACAACGATTGGCTGCCCGTGACATTTGGACAGG GGACGAAGGTGGAAATCAAA |
| 139113-aa VH | 1047 | EVQLVETGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139113-aa VL | 1048 | ETTLTQSPATLSVSPGERATLSCRASQSVGSNLAWYQQKPGQGPRLLIYG ASTRATGIPARFSGSGSGTEFTLTISSLQPEDFAVYYCQQYNDWLPVTFG QGTKVEIK |
| 139113-aa Full CAR | 1049 | MALPVTALLLPLALLLHAARPEVQLVETGGGLVQPGGSLRLSCAVSGFAL SNHGMSWVRRAPGKGLEWVSGIVYSGSTYYAASVKGRFTISRDNSRNTLY LQMNSLRPEDTAIYYCSAHGGESDVWGQGTTVTVSSASGGGGSGGRASGG GGSETTLTQSPATLSVSPGERATLSCRASQSVGSNLAWYQQKPGQGPRLL IYGASTRATGIPARFSGSGSGTEFTLTISSLQPEDFAVYYCQQYNDWLPV TFGQGTKVEIKTTTPAPRPPTPAPTIASQPLSLRPEACRPAAGGAVHTRG LDFACDIYIWAPLAGTCGVLLLSLVITLYCKRGRKKLLYIFKQPFMRPVQ TTQEEDGCSCRFPEEEEGGCELRVKFSRSADAPAYKQGQNQLYNELNLGR REEYDVLDKRRGRDPEMGGKPRRKNPQEGLYNELQKDKMAEAYSEIGMKG ERRRGKGHDGLYQGLSTATKDTYDALHMQALPPR |
| 139113-nt Full CAR | 1050 | ATGGCCCTCCCTGTCACCGCCCTGCTGCTTCCGCTGGCTCTTCTGCTCCA CGCCGCTCGGCCCGAAGTGCAATTGGTGGAAACTGGAGGAGGACTTGTGC AACCTGGAGGATCATTGCGGCTCTCATGCGCTGTCTCCGGCTTCGCCCTG TCAAATCACGGGATGTCGTGGGTCAGACGGGCCCCGGGAAAGGGTCTGGA ATGGGTGTCGGGGATTGTGTACAGCGGCTCCACCTACTACGCCGCTTCGG TCAAGGGCCGCTTCACTATTTCACGGGACAACAGCCGCAACACCCTCTAT CTGCAAATGAACTCTCTCCGCCCGGAGGATACCGCCATCTACTACTGCTC CGCACACGGCGGCGAATCCGACGTGTGGGGACAGGGAACCACTGTCACCG TGTCGTCCGCATCCGGTGGCGGAGGATCGGGTGGCCGGGCCTCCGGGGGC GGCGGCAGCGAGACTACCCTGACCCAGTCCCCTGCCACTCTGTCCGTGAG CCCGGGAGAGAGAGCCACCCTTAGCTGCCGGGCCAGCCAGAGCGTGGGCT CCAACCTGGCCTGGTACCAGCAGAAGCCAGGACAGGGTCCCAGGCTGCTG ATCTACGGAGCCTCCACTCGCGCGACCGGCATCCCCGCGAGGTTCTCCGG GTCGGGTTCCGGGACCGAGTTCACCCTGACCATCTCCTCCCTCCAACCGG AGGACTTCGCGGTGTACTACTGTCAGCAGTACAACGATTGGCTGCCCGTG ACATTTGGACAGGGGACGAAGGTGGAAATCAAAACCACTACCCCAGCACC GAGGCCACCCACCCCGGCTCCTACCATCGCCTCCCAGCCTCTGTCCCTGC GTCCGGAGGCATGTAGACCCGCAGCTGGTGGGGCCGTGCATACCCGGGGT CTTGACTTCGCCTGCGATATCTACATTTGGGCCCCTCTGGCTGGTACTTG CGGGGTCCTGCTGCTTTCACTCGTGATCACTCTTTACTGTAAGCGCGGTC GGAAGAAGCTGCTGTACATCTTTAAGCAACCCTTCATGAGGCCTGTGCAG ACTACTCAAGAGGAGGACGGCTGTTCATGCCGGTTCCCAGAGGAGGAGGA AGGCGGCTGCGAACTGCGCGTGAAATTCAGCCGCAGCGCAGATGCTCCAG CCTACAAGCAGGGCCAGAACCAGCTCTACAACGAACTCAATCTTGGTCGG AGAGAGGAGTACGACGTGCTGGACAAGCGGAGAGGACGGGACCCAGAAAT GGGCGGGAAGCCGCGCAGAAAGAATCCCCAAGAGGGCCTGTACAACGAGC TCCAAAAGGATAAGATGGCAGAAGCCTATAGCGAGATTGGTATGAAAGGG GAACGCAGAAGAGGCAAAGGCCACGACGGACTGTACCAGGGACTCAGCAC CGCCACCAAGGACACCTATGACGCTCTTCACATGCAGGCCCTGCCGCCTC GG |

139114

| 139114-aa ScFv domain | 1051 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSEIVLTQSPGTLSLSPGER ATLSCRASQSIGSSSLAWYQQKPGQAPRLLMYGASSRASGIPDRFSGSGS GTDFTLTISRLEPEDFAVYYCQQYAGSPPFTFGQGTKVEIK |
| 139114-nt ScFv domain | 1052 | GAAGTGCAATTGGTGGAATCTGGTGGAGGACTTGTGCAACCTGGAGGATC ACTGAGACTGTCATGCGCGGTGTCCGGTTTTGCCCTGAGCAATCATGGGA TGTCGTGGGTCCGGCGCGCCCCCGGAAAGGGTCTGGAATGGGTGTCGGGT ATCGTCTACTCCGGGAGCACTTACTACGCCGCGAGCGTGAAGGGCCGCTT CACCATTTCCCGCGATAACTCCCGCAACACCCTGTACTTGCAAATGAACT |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | CGCTCCGGCCTGAGGACACTGCCATCTACTACTGCTCCGCACACGGAGGA<br>GAATCCGACGTGTGGGGCCAGGGAACTACCGTGACCGTCAGCAGCGCCTC<br>CGGCGGCGGGGGCTCAGGCGGACGGGCTAGCGGCGGCGGTGGCTCCGAGA<br>TCGTGCTGACCCAGTCGCCTGGCACTCTCTCGCTGAGCCCCGGGGAAAGG<br>GCAACCCTGTCCTGTCGGGCCAGCCAGTCCATTGGATCATCCTCCCTCGC<br>CTGGTATCAGCAGAAACCGGGACAGGCTCCGCGGCTGCTTATGTATGGGG<br>CCAGCTCAAGAGCCTCCGGCATTCCCGACCGGTTCTCCGGGTCCGGTTCC<br>GGCACCGATTTCACCCTGACTATCTCGAGGCTGGAGCCAGAGGACTTCGC<br>CGTGTACTACTGCCAGCAGTACGCGGGGTCCCCGCCGTTCACGTTCGGAC<br>AGGGAACCAAGGTCGAGATCAAG |
| 139114-aa<br>VH | 1053 | EVQLVESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139114-aa<br>VL | 1054 | EIVLTQSPGTLSLSPGERATLSCRASQSIGSSSLAWYQQKPGQAPRLLMY<br>GASSRASGIPDRFSGSGSGTDFTLTISRLEPEDFAVYYCQQYAGSPPFTF<br>GQGTKVEIK |
| 139114-aa<br>Full CAR | 1055 | MALPVTALLLPLALLLHAARPEVQLVESGGGLVQPGGSLRLSCAVSGFAL<br>SNHGMSWVRRAPGKGLEWVSGIVYSGSTYYAASVKGRFTISRDNSRNTLY<br>LQMNSLRPEDTAIYYCSAHGGESDVWGQGTTVTVSSASGGGGSGGRASGG<br>GGSEIVLTQSPGTLSLSPGERATLSCRASQSIGSSSLAWYQQKPGQAPRL<br>LMYGASSRASGIPDRFSGSGSGTDFTLTISRLEPEDFAVYYCQQYAGSPP<br>FTFGQGTKVEIKTTTPAPRPPTPAPTIASQPLSLRPEACRPAAGGAVHTR<br>GLDFACDIYIWAPLAGTCGVLLLSLVITLYCKRGRKKLLYIFKQPFMRPV<br>QTTQEEDGCSCRFPEEEEGGCELRVKFSRSADAPAYKQGQNQLYNELNLG<br>RREEYDVLDKRRGRDPEMGGKPRRKNPQEGLYNELQKDKMAEAYSEIGMK<br>GERRRGKGHDGLYQGLSTATKDTYDALHMQALPPR |
| 139114-nt<br>Full CAR | 1056 | ATGGCCCTCCCTGTCACCGCCCTGCTGCTTCCGCTGGCTCTTCTGCTCCA<br>CGCCGCTCGGCCCGAAGTGCAATTGGTGGAATCTGGTGGAGGACTTGTGC<br>AACCTGGAGGATCACTGAGACTGTCATGCGCGGTGTCCGGTTTTGCCCTG<br>AGCAATCATGGGATGTCGTGGGTCCGGCGCGCCCCCGGAAAGGGTCTGGA<br>ATGGGTGTCGGGTATCGTCTACTCCGGGAGCACTTACTACGCCGCGAGCG<br>TGAAGGGCCGCTTCACCATTTCCCGCGATAACTCCCGCAACACCCTGTAC<br>TTGCAAATGAACTCGCTCCGGCCTGAGGACACTGCCATCTACTACTGCTC<br>CGCACACGGAGGAGAATCCGACGTGTGGGGCCAGGGAACTACCGTGACCG<br>TCAGCAGCGCCTCCGGCGGCGGGGGCTCAGGCGGACGGGCTAGCGGCGGC<br>GGTGGCTCCGAGATCGTGCTGACCCAGTCGCCTGGCACTCTCTCGCTGAG<br>CCCCGGGGAAAGGGCAACCCTGTCCTGTCGGGCCAGCCAGTCCATTGGAT<br>CATCCTCCCTCGCCTGGTATCAGCAGAAACCGGGACAGGCTCCGCGGCTG<br>CTTATGTATGGGGCCAGCTCAAGAGCCTCCGGCATTCCCGACCGGTTCTC<br>CGGGTCCGGTTCCGGCACCGATTTCACCCTGACTATCTCGAGGCTGGAGC<br>CAGAGGACTTCGCCGTGTACTACTGCCAGCAGTACGCGGGGTCCCCGCCG<br>TTCACGTTCGGACAGGGAACCAAGGTCGAGATCAAGACCACTACCCCAGC<br>ACCGAGGCCACCCACCCCGGCTCCTACCATCGCCTCCCAGCCTCTGTCCC<br>TGCGTCCGGAGGCATGTAGACCCGCAGCTGGTGGGGCCGTGCATACCCGG<br>GGTCTTGACTTCGCCTGCGATATCTACATTTGGGCCCCTCTGGCTGGTAC<br>TTGCGGGGTCCTGCTGCTTTCACTCGTGATCACTCTTTACTGTAAGCGCG<br>GTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGA<br>GGAAGGCGGCTGCGAACTGCGCGTGAAATTCAGCCGCAGCGCAGATGCTC<br>CAGCCTACAAGCAGGGGCAGAACCAGCTCTACAACGAACTCAATCTTGGT<br>CGGGAGAGAGGAGTACGACGTGCTGGACAAGCGGAGAGGACGGGACCCAGA<br>AATGGGCGGGAAGCCGCGCAGAAAGAATCCCCAAGAGGGCCTGTACAACG<br>AGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAG<br>CACCGCCACCAAGGACACCTATGACGCTCTTCACATGCAGGCCCTGCCGC<br>CTCGG |

149362

| 149362-aa<br>ScFv domain | 1057 | QVQLQESGPGLVKPSETLSLTCTVSGGSISSSYYYWGWIRQPPGKGLEWI<br>GSIYYSGSAYYNPSLKSRVTISVDTSKNQFSLRLSSVTAADTAVYYCARH<br>WQEWPDAFDIWGQGTMVTVSSGGGGSGGGGSGGGGSETTLTQSPAFMSAT<br>PGDKVIISCKASQDIDDAMNWYQQKPGEAPLFIIQSATSPVPGIPPRFSG<br>SGFGTDFSLTINNIESEDAAYYFCLQHDNFPLTFGQGTKLEIK |
| 149362-nt<br>ScFv domain | 1058 | CAAGTGCAGCTTCAGGAAAGCGGACCGGGCCTGGTCAAGCCATCCGAAAC<br>TCTCTCCCTGACTTGCACTGTGTCTGGCGGTTCCATCTCATCGTCGTACT<br>ACTACTGGGGCTGGATTAGGCAGCCGCCCGGAAAGGGACTGGAGTGGATC<br>GGAAGCATCTACTATTCCGGCTCGGCGTACTACAACCCTAGCCTCAAGTC |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | GAGAGTGACCATCTCCGTGGATACCTCCAAGAACCAGTTTTCCCTGCGCC<br>TGAGCTCCGTGACCGCCGCTGACACCGCCGTGTACTACTGTGCTCGGCAT<br>TGGCAGGAATGGCCCGATGCCTTCGACATTTGGGGCCAGGGCACTATGGT<br>CACTGTGTCATCCGGGGGTGGAGGCAGCGGGGGAGGAGGGTCCGGGGGGG<br>GAGGTTCAGAGACAACCTTGACCCAGTCACCCGCATTCATGTCCGCCACT<br>CCGGGAGACAAGGTCATCATCTCGTGCAAAGCGTCCCAGGATATCGACGA<br>TGCCATGAATTGGTACCAGCAGAAGCCTGGCGAAGCGCCGCTGTTCATTA<br>TCCAATCCGCAACCTCGCCCGTGCCTGGAATCCCACCGCGGTTCAGCGGC<br>AGCGGTTTCGGAACCGACTTTTCCCTGACCATTAACAACATTGAGTCCGA<br>GGACGCCGCCTACTACTTCTGCCTGCAACACGACAACTTCCCTCTCACGT<br>TCGGCCAGGGAACCAAGCTGGAAATCAAG |
| 149362-aa<br>VH | 1059 | QVQLQESGPGLVKPSETLSLTCTVSGGSISSSYYYWGWIRQPPGKGLEWI<br>GSIYYSGSAYYNPSLKSRVTISVDTSKNQFSLRLSSVTAADTAVYYCARH<br>WQEWPDAFDIWGQGTMVTVSS |
| 149362-aa VL | 1060 | ETTLTQSPAFMSATPGDKVIISCKASQDIDDAMNWYQQKPGEAPLFIIQS<br>ATSPVPGIPPRFSGSGFGTDFSLTINNIESEDAAYYFCLQHDNFPLTFGQ<br>GTKLEIK |
| 149362-aa<br>Full CAR | 1061 | MALPVTALLLPLALLLHAARPQVQLQESGPGLVKPSETLSLTCTVSGGSI<br>SSSYYYWGWIRQPPGKGLEWIGSIYYSGSAYYNPSLKSRVTISVDTSKNQ<br>FSLRLSSVTAADTAVYYCARHWQEWPDAFDIWGQGTMVTVSSGGGGSGGG<br>GSGGGGSETTLTQSPAFMSATPGDKVIISCKASQDIDDAMNWYQQKPGEA<br>PLFIIQSATSPVPGIPPRFSGSGFGTDFSLTINNIESEDAAYYFCLQHDN<br>FPLTFGQGTKLEIKTTTPAPRPPTPAPTIASQPLSLRPEACRPAAGGAVH<br>TRGLDFACDIYIWAPLAGTCGVLLLSLVITLYCKRGRKKLLYIFKQPFMR<br>PVQTTQEEDGCSCRFPEEEEGGCELRVKFSRSADAPAYKQGQNQLYNELN<br>LGRREEYDVLDKRRGRDPEMGGKPRRKNPQEGLYNELQKDKMAEAYSEIG<br>MKGERRRGKGHDGLYQGLSTATKDTYDALHMQALPPR |
| 149362-nt<br>Full CAR | 1062 | ATGGCCCTCCCTGTCACCGCCCTGCTGCTTCCGCTGGCTCTTCTGCTCCA<br>CGCCGCTCGGCCCCAAGTGCAGCTTCAGGAAAGCGGACCGGGCCTGGTCA<br>AGCCATCCGAAACTCTCTCCCTGACTTGCACTGTGTCTGGCGGTTCCATC<br>TCATCGTCGTACTACTACTGGGGCTGGATTAGGCAGCCGCCCGGAAAGGG<br>ACTGGAGTGGATCGGAAGCATCTACTATTCCGGCTCGGCGTACTACAACC<br>CTAGCCTCAAGTCGAGAGTGACCATCTCCGTGGATACCTCCAAGAACCAG<br>TTTTCCCTGCGCCTGAGCTCCGTGACCGCCGCTGACACCGCCGTGTACTA<br>CTGTGCTCGGCATTGGCAGGAATGGCCCGATGCCTTCGACATTTGGGGCC<br>AGGGCACTATGGTCACTGTGTCATCCGGGGGTGGAGGCAGCGGGGGAGGA<br>GGGTCCGGGGGGGGAGGTTCAGAGACAACCTTGACCCAGTCACCCGCATT<br>CATGTCCGCCACTCCGGGAGACAAGGTCATCATCTCGTGCAAAGCGTCCC<br>AGGATATCGACGATGCCATGAATTGGTACCAGCAGAAGCCTGGCGAAGCG<br>CCGCTGTTCATTATCCAATCCGCAACCTCGCCCGTGCCTGGAATCCCACC<br>GCGGTTCAGCGGCAGCGGTTTCGGAACCGACTTTTCCCTGACCATTAACA<br>ACATTGAGTCCGAGGACGCCGCCTACTACTTCTGCCTGCAACACGACAAC<br>TTCCCTCTCACGTTCGGCCAGGGAACCAAGCTGGAAATCAAGACCACTAC<br>CCCAGCACCGAGGCCACCCACCCCGGCTCCTACCATCGCCTCCCAGCCTC<br>TGTCCCTGCGTCCGGAGGCATGTAGACCCGCAGCTGGTGGGGCCGTGCAT<br>ACCCGGGGTCTTGACTTCGCCTGCGATATCTACATTTGGGCCCCTCTGGC<br>TGGTACTTGCGGGGTCCTGCTGCTTTCACTCGTGATCACTCTTTACTGTA<br>AGCGCGGTCGGAAGAAGCTGCTGTACATCTTTAAGCAACCCTTCATGAGG<br>CCTGTGCAGACTACTCAAGAGGAGGACGGCTGTTCATGCCGGTTCCCAGA<br>GGAGGAGGAAGGCGGCTGCGAACTGCGCGTGAAATTCAGCCGCAGCGCAG<br>ATGCTCCAGCCTACAAGCAGGGGCAGAACCAGCTCTACAACGAACTCAAT<br>CTTGGTCGGAGAGAGGAGTACGACGTGCTGGACAAGCGGAGAGGACGGGA<br>CCCAGAAATGGGCGGGAAGCCGCGCAGAAAGAATCCCCAAGAGGGCCTGT<br>ACAACGAGCTCCAAAAGGATAAGATGGCAGAAGCCTATAGCGAGATTGGT<br>ATGAAAGGGGAACGCAGAAGAGGCAAAGGCCACGACGGACTGTACCAGGG<br>ACTCAGCACCGCCACCAAGGACACCTATGACGCTCTTCACATGCAGGCCC<br>TGCCGCCTCGG |

149363

| 149363-aa<br>ScFv domain | 1063 | VNLRESGPALVKPTQTLTLTCTFSGFSLRTSGMCVSWIRQPPGKALEWLA<br>RIDWDEDKFYSTSLKTRLTISKDTSDNQVVLRMTNMDPADTATYYCARSG<br>AGGTSATAFDIWGPGTMVTVSSGGGGSGGGGSGGGGSDIQMTQSPSSLSA<br>SVGDRVTITCRASQDIYNNLAWFQLKPGSAPRSLMYAANKSQSGVPSRFS<br>GSASGTDFTLTISSLQPEDFATYYCQHYYRFPYSFGQGTKLEIK |
| 149363-nt<br>ScFv domain | 1064 | CAAGTCAATCTGCGCGAATCCGGCCCCGCCTTGGTCAAGCCTACCCAGAC<br>CCTCACTCTGACCTGTACTTTCTCCGGCTTCTCCCTGCGGACTTCCGGGA<br>TGTGCGTGTCCTGGATCAGACAGCCTCCGGGAAAGGCCCTGGAGTGGCTC |

TABLE 5-continued

Amino Acid and Nucleic Acid Sequences of exemplary anti-BCMA scFv domains and BCMA CAR molecules

| Name/<br>Description | SEQ<br>ID<br>NO: | Sequence |
|---|---|---|
| | | GCTCGCATTGACTGGGATGAGGACAAGTTCTACTCCACCTCACTCAAGAC<br>CAGGCTGACCATCAGCAAAGATACCTCTGACAACCAAGTGGTGCTCCGCA<br>TGACCAACATGGACCCAGCCGACACTGCCACTTACTACTGCGCGAGGAGC<br>GGAGCGGGCGGAACCTCCGCCACCGCCTTCGATATTTGGGGCCCGGGTAC<br>CATGGTCACCGTGTCAAGCGGAGGAGGGGGGTCCGGGGGCGGCGGTTCCG<br>GGGGAGGCGGATCGGACATTCAGATGACTCAGTCACCATCGTCCCTGAGC<br>GCTAGCGTGGGCGACAGAGTGACAATCACTTGCCGGGCATCCCAGGACAT<br>CTATAACAACCTTGCGTGGTTCCAGCTGAAGCCTGGTTCCGCACCGCGGT<br>CACTTATGTACGCCGCCAACAAGAGCCAGTCGGGAGTGCCGTCCCGGTTT<br>TCCGGTTCGGCCTCGGGAACTGACTTCACCCTGACGATCTCCAGCCTGCA<br>ACCCGAGGATTTCGCCACCTACTACTGCCAGCACTACTACCGCTTTCCCT<br>ACTCGTTCGGACAGGGAACCAAGCTGGAAATCAAG |
| 149363-aa<br>VH | 1065 | QVNLRESGPALVKPTQTLTLTCTFSGFSLRTSGMCVSWIRQPPGKALEWL<br>ARIDWDEDKFYSTSLKTRLTISKDTSDNQVVLRMTNMDPADTATYYCARS<br>GAGGTSATAFDIWGPGTMVTVSS |
| 149363-aa VL | 1066 | DIQMTQSPSSLSASVGDRVTITCRASQDIYNNLAWFQLKPGSAPRSLMYA<br>ANKSQSGVPSRFSGSASGTDFTLTISSLQPEDFATYYCQHYYRFPYSFGQ<br>GTKLEIK |
| 149363-aa<br>Full CAR | 1067 | MALPVTALLLPLALLLHAARPQVNLRESGPALVKPTQTLTLTCTFSGFSL<br>RTSGMCVSWIRQPPGKALEWLARIDWDEDKFYSTSLKTRLTISKDTSDNQ<br>VVLRMTNMDPADTATYYCARSGAGGTSATAFDIWGPGTMVTVSSGGGGSG<br>GGGSGGGGSDIQMTQSPSSLSASVGDRVTITCRASQDIYNNLAWFQLKPG<br>SAPRSLMYAANKSQSGVPSRFSGSASGTDFTLTISSLQPEDFATYYCQHY<br>YRFPYSFGQGTKLEIKTTTPAPRPPTPAPTIASQPLSLRPEACRPAAGGA<br>VHTRGLDFACDIYIWAPLAGTCGVLLLSLVITLYCKRGRKKLLYIFKQPF<br>MRPVQTTQEEDGCSCRFPEEEEGGCELRVKFSRSADAPAYKQGQNQLYNE<br>LNLGRREEYDVLDKRRGRDPEMGGKPRRKNPQEGLYNELQKDKMAEAYSE<br>IGMKGERRRGKGHDGLYQGLSTATKDTYDALHMQALPPR |
| 149363-nt<br>Full CAR | 1068 | ATGGCCCTCCCTGTCACCGCCCTGCTGCTTCCGCTGGCTCTTCTGCTCCA<br>CGCCGCTCGGCCCCAAGTCAATCTGCGCGAATCCGGCCCCGCCTTGGTCA<br>AGCCTACCCAGACCCTCACTCTGACCTGTACTTTCTCCGGCTTCTCCCTG<br>CGGACTTCCGGGATGTGCGTGTCCTGGATCAGACAGCCTCCGGGAAAGGC<br>CCTGGAGTGGCTCGCTCGCATTGACTGGGATGAGGACAAGTTCTACTCCA<br>CCTCACTCAAGACCAGGCTGACCATCAGCAAAGATACCTCTGACAACCAA<br>GTGGTGCTCCGCATGACCAACATGGACCCAGCCGACACTGCCACTTACTA<br>CTGCGCGAGGAGCGGAGCGGGCGGAACCTCCGCCACCGCCTTCGATATTT<br>GGGGCCCGGGTACCATGGTCACCGTGTCAAGCGGAGGAGGGGGGTCCGGG<br>GGCGGCGGTTCCGGGGGAGGCGGATCGGACATTCAGATGACTCAGTCACC<br>ATCGTCCCTGAGCGCTAGCGTGGGCGACAGAGTGACAATCACTTGCCGGG<br>CATCCCAGGACATCTATAACAACCTTGCGTGGTTCCAGCTGAAGCCTGGT<br>TCCGCACCGCGGTCACTTATGTACGCCGCCAACAAGAGCCAGTCGGGAGT<br>GCCGTCCCGGTTTTCCGGTTCGGCCTCGGGAACTGACTTCACCCTGACGA<br>TCTCCAGCCTGCAACCCGAGGATTTCGCCACCTACTACTGCCAGCACTAC<br>TACCGCTTTCCCTACTCGTTCGGACAGGGAACCAAGCTGGAAATCAAGAC<br>CACTACCCCAGCACCGAGGCCACCCACCCCGGCTCCTACCATCGCCTCCC<br>AGCCTCTGTCCCTGCGTCCGAGGCATGTAGACCCGCAGCTGGTGGGGCC<br>GTGCATACCCGGGGTCTTGACTTCGCCTGCGATATCTACATTTGGGCCCC<br>TCTGGCTGGTACTTGCGGGGTCCTGCTGCTTTCACTCGTGATCACTCTTT<br>ACTGTAAGCGCGGTCGGAAGAAGCTGCTGTACATCTTTAAGCAACCCTTC<br>ATGAGGCCTGTGCAGACTACTCAAGAGGAGGACGGCTGTTCATGCCGGTT<br>CCCAGAGGAGGAGGAAGGCGGCTGCGAACTGCGCGTGAAATTCAGCCGCA<br>GCGCAGATGCTCCAGCCTACAAGCAGGGCAGAACCAGCTCTACAACGAA<br>CTCAATCTTGGTCGGAGAGAGGAGTACGACGTGCTGGACAAGCGGAGAGG<br>ACGGGACCCAGAAATGGGCGGGAAGCCGCGCAGAAAGAATCCCCAAGAGG<br>GCCTGTACAACGAGCTCCAAAAGGATAAGATGGCAGAAGCCTATAGCGAG<br>ATTGGTATGAAAGGGGAACGCAGAAGAGGCAAAGGCCACGACGGACTGTA<br>CCAGGGACTCAGCACCGCCACCAAGGACACCTATGACGCTCTTCACATGC<br>AGGCCCTGCCGCCTCGG |

149364

| 149364-aa<br>ScFv domain | 1069 | EVQLVESGGGLVKPGGSLRLSCAASGFTFSSYSMNWVRQAPGKGLEWVSS<br>ISSSSSYIYYADSVKGRFTISRDNAKNSLYLQMNSLRAEDTAVYYCAKTI<br>AAVYAFDIWGQGTTVTVSSGGGGSGGGGSGGGGSEIVLTQSPLSLPVTPE<br>EPASISCRSSQSLLHSNGYNYLDWYLQKPGQSPQLLIYLGSNRASGVPDR<br>FSGSGSGTDFTLKISRVEAEDVGVYYCMQALQTPYTFGQGTKLEIK |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| 149364-nt<br>ScFv domain | 1070 | GAAGTGCAGCTTGTCGAATCCGGGGGGGGACTGGTCAAGCCGGGCGGATC<br>ACTGAGACTGTCCTGCGCCGCGAGCGGCTTCACGTTCTCCTCCTACTCCA<br>TGAACTGGGTCCGCCAAGCCCCCGGGAAGGGACTGGAATGGGTGTCCTCT<br>ATCTCCTCGTCGTCGTCCTACATCTACTACGCCGACTCCGTGAAGGGAAG<br>ATTCACCATTTCCCGCGACAACGCAAAGAACTCACTGTACTTGCAAATGA<br>ACTCACTCCGGGCCGAAGATACTGCTGTGTACTATTGCGCCAAGACTATT<br>GCCGCCGTCTACGCTTTCGACATCTGGGGCCAGGGAACCACCGTGACTGT<br>GTCGTCCGGTGGTGGTGGCTCGGGCGGAGGAGGAAGCGGCGGCGGGGGGT<br>CCGAGATTGTGCTGACCCAGTCGCCACTGAGCCTCCCTGTGACCCCCGAG<br>GAACCCGCCAGCATCAGCTGCCGGTCCAGCCAGTCCCTGCTCCACTCCAA<br>CGGATACAATTACCTCGATTGGTACCTTCAGAAGCCTGGACAAAGCCCGC<br>AGCTGCTCATCTACTTGGGATCAAACCGCGCGTCAGGAGTGCCTGACCGG<br>TTCTCCGGCTCGGGCAGCGGTACCGATTTCACCCTGAAAATCTCCAGGGT<br>GGAGGCAGAGGACGTGGGAGTGTATTACTGTATGCAGGCGCTGCAGACTC<br>CGTACACATTTGGGCAGGGCACCAAGCTGGAGATCAAG |
| 149364-aa<br>VH | 1071 | EVQLVESGGGLVKPGGSLRLSCAASGFTFSSYSMNWVRQAPGKGLEWVSS<br>ISSSSSYIYYADSVKGRFTISRDNAKNSLYLQMNSLRAEDTAVYYCAKTI<br>AAVYAFDIWGQGTTVTVSS |
| 149364-aa VL | 1072 | EIVLTQSPLSLPVTPEEPASISCRSSQSLLHSNGYNYLDWYLQKPGQSPQ<br>LLIYLGSNRASGVPDRFSGSGSGTDFTLKISRVEAEDVGVYYCMQALQTP<br>YTFGQGTKLEIK |
| 149364-aa<br>Full CAR | 1073 | MALPVTALLLPLALLLHAARPEVQLVESGGGLVKPGGSLRLSCAASGFTF<br>SSYSMNWVRQAPGKGLEWVSSISSSSSYIYYADSVKGRFTISRDNAKNSL<br>YLQMNSLRAEDTAVYYCAKTIAAVYAFDIWGQGTTVTVSSGGGGSGGGGS<br>GGGGSEIVLTQSPLSLPVTPEEPASISCRSSQSLLHSNGYNYLDWYLQKP<br>GQSPQLLIYLGSNRASGVPDRFSGSGSGTDFTLKISRVEAEDVGVYYCMQ<br>ALQTPYTFGQGTKLEIKTTTPAPRPPTPAPTIASQPLSLRPEACRPAAGG<br>AVHTRGLDFACDIYIWAPLAGTCGVLLLSLVITLYCKRGRKKLLYIFKQP<br>FMRPVQTTQEEDGCSCRFPEEEEGGCELRVKFSRSADAPAYKQGQNQLYN<br>ELNLGRREEYDVLDKRRGRDPEMGGKPRRKNPQEGLYNELQKDKMAEAYS<br>EIGMKGERRRGKGHDGLYQGLSTATKDTYDALHMQALPPR |
| 149364-nt<br>Full CAR | 1074 | ATGGCCCTCCCTGTCACCGCCCTGCTGCTTCCGCTGGCTCTTCTGCTCCA<br>CGCCGCTCGGCCCGAAGTGCAGCTTGTCGAATCCGGGGGGGGACTGGTCA<br>AGCCGGGCGGATCACTGAGACTGTCCTGCGCCGCGAGCGGCTTCACGTTC<br>TCCTCCTACTCCATGAACTGGGTCCGCCAAGCCCCCGGGAAGGGACTGGA<br>ATGGGTGTCCTCTATCTCCTCGTCGTCGTCCTACATCTACTACGCCGACT<br>CCGTGAAGGGAAGATTCACCATTTCCCGCGACAACGCAAAGAACTCACTG<br>TACTTGCAAATGAACTCACTCCGGGCCGAAGATACTGCTGTGTACTATTG<br>CGCCAAGACTATTGCCGCCGTCTACGCTTTCGACATCTGGGGCCAGGGAA<br>CCACCGTGACTGTGTCGTCCGGTGGTGGTGGCTCGGGCGGAGGAGGAAGC<br>GGCGGCGGGGGGTCCGAGATTGTGCTGACCCAGTCGCCACTGAGCCTCCC<br>TGTGACCCCCGAGGAACCCGCCAGCATCAGCTGCCGGTCCAGCCAGTCCC<br>TGCTCCACTCCAACGGATACAATTACCTCGATTGGTACCTTCAGAAGCCT<br>GGACAAAGCCCGCAGCTGCTCATCTACTTGGGATCAAACCGCGCGTCAGG<br>AGTGCCTGACCGGTTCTCCGGCTCGGGCAGCGGTACCGATTTCACCCTGA<br>AAATCTCCAGGGTGGAGGCAGAGGACGTGGGAGTGTATTACTGTATGCAG<br>GCGCTGCAGACTCCGTACACATTTGGGCAGGGCACCAAGCTGGAGATCAA<br>GACCACTACCCCAGCACCGAGGCCACCCACCCCGGCTCCTACCATCGCCT<br>CCCAGCCTCTGTCCCTGCGTCCGGAGGCATGTAGACCCGCAGCTGGTGGG<br>GCCGTGCATACCCGGGGTCTTGACTTCGCCTGCGATATCTACATTTGGGC<br>CCCTCTGGCTGGTACTTGCGGGTCCTGCTGCTTTCACTCGTGATCACTC<br>TTTACTGTAAGCGCGGTCGGAAGAAGCTGCTGTACATCTTTAAGCAACCC<br>TTCATGAGGCCTGTGCAGACTACTCAAGAGGAGGACGGCTGTTCATGCCG<br>GTTCCCAGAGGAGGAGGAAGGCGGCTGCGAACTGCGCGTGAAATTCAGCC<br>GCAGCGCAGATGCTCCAGCCTACAAGCAGGGGCAGAACCAGCTCTACAAC<br>GAACTCAATCTTGGTCGGAGAGAGGAGTACGACGTGCTGGACAAGCGGAG<br>AGGACGGGACCCAGAAATGGGCGGGAAGCCGCGCAGAAAGAATCCCCAAG<br>AGGGCCTGTACAACGAGCTCCAAAAGGATAAGATGGCAGAAGCCTATAGC<br>GAGATTGGTATGAAGGGGAACGCAGAAGAGGCAAAGGCCACGACGGACT<br>GTACCAGGGACTCAGCACCGCCACCAAGGACACCTATGACGCTCTTCACA<br>TGCAGGCCCTGCCGCCTCGG |

149365

| 149365-aa<br>ScFv domain | 1075 | EVQLVESGGGLVKPGGSLRLSCAASGFTFSDYYMSWIRQAPGKGLEWVSY<br>ISSSGSTIYYADSVKGRFTISRDNAKNSLYLQMNSLRAEDTAVYYCARDL |

TABLE 5-continued

Amino Acid and Nucleic Acid Sequences of exemplary anti-BCMA scFv domains and BCMA CAR molecules

| Name/Description | SEQ ID NO: | Sequence |
|---|---|---|
| | | RGAFDIWGQGTMVTVSSGGGGSGGGGSGGGGSSYVLTQSPSVSAAPGYTA<br>TISCGGNNIGTKSVHWYQQKPGQAPLLVIRDDSVRPSKIPGRFSGSNSGN<br>MATLTISGVQAGDEADFYCQVWDSDSEHVVFGGGTKLTVL |
| 149365-nt ScFv domain | 1076 | GAAGTCCAGCTCGTGGAGTCCGGCGGAGGCCTTGTGAAGCCTGGAGGTTC<br>GCTGAGACTGTCCTGCGCCGCCTCCGGCTTCACCTTCTCCGACTACTACA<br>TGTCCTGGATCAGACAGGCCCCGGGAAAGGGCCTGGAATGGGTGTCCTAC<br>ATCTCGTCATCGGGCAGCACTATCTACTACGCGGACTCAGTGAAGGGGCG<br>GTTCACCATTTCCCGGGATAACGCGAAGAACTCGCTGTATCTGCAAATGA<br>ACTCACTGAGGGCCGAGGACACCGCCGTGTACTACTGCGCCCGCGATCTC<br>CGCCGGGGCATTTGACATCTGGGGACAGGGAACCATGGTCACAGTGTCCAG<br>CGGAGGGGGAGGATCGGGTGGCGGAGGTTCCGGGGGTGGAGGCTCCTCCT<br>ACGTGCTGACTCAGAGCCCAAGCGTCAGCGCTGCGCCCGGTTACACGGCA<br>ACCATCTCCTGTGGCGGAAACAACATTGGGACCAAGTCTGTGCACTGGTA<br>TCAGCAGAAGCCGGGCCAAGCTCCCCTGTTGGTGATCCGCGATGACTCCG<br>TGCGGCCTAGCAAAATTCCGGGACGGTTCTCCGGCTCCAACAGCGGCAAT<br>ATGGCCACTCTCACCATCTCGGGAGTGCAGGCCGGAGATGAAGCCGACTT<br>CTACTGCCAAGTCTGGGACTCAGACTCCGAGCATGTGGTGTTCGGGGGCG<br>GAACCAAGCTGACTGTGCTC |
| 149365-aa VH | 1077 | EVQLVESGGGLVKPGGSLRLSCAASGFTFSDYYMSWIRQAPGKGLEWVSY<br>ISSSGSTIYYADSVKGRFTISRDNAKNSLYLQMNSLRAEDTAVYYCARDL<br>RGAFDIWGQGTMVTVSS |
| 149365-aa VL | 1078 | SYVLTQSPSVSAAPGYTATISCGGNNIGTKSVHWYQQKPGQAPLLVIRDD<br>SVRPSKIPGRFSGSNSGNMATLTISGVQAGDEADFYCQVWDSDSEHVVFG<br>GGTKLTVL |
| 149365-aa Full CAR | 1079 | MALPVTALLLPLALLLHAARPEVQLVESGGGLVKPGGSLRLSCAASGFTF<br>SDYYMSWIRQAPGKGLEWVSYISSSGSTIYYADSVKGRFTISRDNAKNSL<br>YLQMNSLRAEDTAVYYCARDLRGAFDIWGQGTMVTVSSGGGGSGGGGSGG<br>GGSSYVLTQSPSVSAAPGYTATISCGGNNIGTKSVHWYQQKPGQAPLLVI<br>RDDSVRPSKIPGRFSGSNSGNMATLTISGVQAGDEADFYCQVWDSDSEHV<br>VFGGGTKLTVLTTTPAPRPPTPAPTIASQPLSLRPEACRPAAGGAVHTRG<br>LDFACDIYIWAPLAGTCGVLLLSLVITLYCKRGRKKLLYIFKQPFMRPVQ<br>TTQEEDGCSCRFPEEEEGGCELRVKFSRSADAPAYKQGQNQLYNELNLGR<br>REEYDVLDKRRGRDPEMGGKPRRKNPQEGLYNELQKDKMAEAYSEIGMKG<br>ERRRGKGHDGLYQGLSTATKDTYDALHMQALPPR |
| 149365-nt Full CAR | 1080 | ATGGCCCTCCCTGTCACCGCCCTGCTGCTTCCGCTGGCTCTTCTGCTCCA<br>CGCCGCTCGGCCCGAAGTCCAGCTCGTGGAGTCCGGCGGAGGCCTTGTGA<br>AGCCTGGAGGTTCGCTGAGACTGTCCTGCGCCGCCTCCGGCTTCACCTTC<br>TCCGACTACTACATGTCCTGGATCAGACAGGCCCCGGGAAAGGGCCTGGA<br>ATGGGTGTCCTACATCTCGTCATCGGGCAGCACTATCTACTACGCGGACT<br>CAGTGAAGGGGCGGTTCACCATTTCCCGGGATAACGCGAAGAACTCGCTG<br>TATCTGCAAATGAACTCACTGAGGGCCGAGGACACCGCCGTGTACTACTG<br>CGCCCGCGATCTCCGCCGGGGCATTTGACATCTGGGGACAGGGAACCATGG<br>TCACAGTGTCCAGCGGAGGGGGAGGATCGGGTGGCGGAGGTTCCGGGGGT<br>GGAGGCTCCTCCTACGTGCTGACTCAGAGCCCAAGCGTCAGCGCTGCGCC<br>CGGTTACACGGCAACCATCTCCTGTGGCGGAAACAACATTGGGACCAAGT<br>CTGTGCACTGGTATCAGCAGAAGCCGGGCCAAGCTCCCCTGTTGGTGATC<br>CGCGATGACTCCGTGCGGCCTAGCAAAATTCCGGGACGGTTCTCCGGCTC<br>CAACAGCGGCAATATGGCCACTCTCACCATCTCGGGAGTGCAGGCCGGAG<br>ATGAAGCCGACTTCTACTGCCAAGTCTGGGACTCAGACTCCGAGCATGTG<br>GTGTTCGGGGGCGGAACCAAGCTGACTGTGCTCACCACTACCCCAGCACC<br>GAGGCCACCCACCCCGGCTCCTACCATCGCCTCCCAGCCTCTGTCCCTGC<br>GTCCGGAGGCATGTAGACCCGCAGCTGGTGGGCCGTGCATACCCGGGGT<br>CTTGACTTCGCCTGCGATATCTACATTTGGGCCCCTCTGGCTGGTACTTG<br>CGGGGTCCTGCTGCTTTCACTCGTGATCACTCTTTACTGTAAGCGCGGTC<br>GGAAGAAGCTGCTGTACATCTTTAAGCAACCCTTCATGAGGCCTGTGCAG<br>ACTACTCAAGAGGAGGACGGCTGTTCATGCCGGTTCCCAGAGGAGGAGGA<br>AGGCGGCTGCGAACTGCGCGTGAAATTCAGCCGCAGCGCAGATGCTCCAG<br>CCTACAAGCAGGGGCAGAACCAGCTCTACAACGAACTCAATCTTGGTCGG<br>AGAGAGGAGTACGACGTGCTGGACAAGCGGAGAGGACGGGACCCAGAAAT<br>GGGCGGGAAGCCGCGCAGAAAGAATCCCCAAGAGGGCCTGTACAACGAGC<br>TCCAAAAGGATAAGATGGCAGAAGCCTATAGCGAGATTGGTATGAAGGG<br>GAACGCAGAAGAGGCAAAGGCCACGACGGACTGTACCAGGGACTCAGCAC<br>CGCCACCAAGGACACCTATGACGCTCTTCACATGCAGGCCCTGCCGCCTC<br>GG |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|

149366

| 149366-aa ScFv domain | 1081 | QVQLVQSGAEVKKPGASVKVSCKPSGYTVTSHYIHWVRRAPGQGLEWMGM INPSGGVTAYSQTLQGRVTMTSDTSSSTVYMELSSLRSEDTAMYYCAREG SGSGWYFDFWGRGTLVTVSSGGGGSGGGGSGGGGSSYVLTQPPSVSVSPG QTASITCSGDGLSKKYVSWYQQKAGQSPVVLISRDKERPSGIPDRFSGSN SADTATLTISGTQAMDEADYYCQAWDDTTVVFGGGTKLTVL |

| 149366-nt ScFv domain | 1082 | CAAGTGCAGCTGGTGCAGAGCGGGGCCGAAGTCAAGAAGCCGGGAGCCTC CGTGAAAGTGTCCTGCAAGCCTTCGGGATACACCGTGACCTCCCACTACA TTCATTGGGTCCGCCGCGCCCCCGGCCAAGGACTCGAGTGGATGGGCATG ATCAACCCTAGCGGCGGAGTGACCGCGTACAGCCAGACGCTGCAGGGACG CGTGACTATGACCTCGGATACCTCCTCCTCCACCGTCTATATGGAACTGT CCAGCCTGCGGTCCGAGGATACCGCCATGTACTACTGCGCCCGGGAAGGA TCAGGCTCCGGGTGGTATTTCGACTTCTGGGGAAGAGGCACCCTCGTGAC TGTGTCATCTGGGGGAGGGGGTTCCGGTGGTGGCGGATCGGGAGGAGGCG GTTCATCCTACGTGCTGACCCAGCCACCCTCCGTGTCCGTGAGCCCCGGC CAGACTGCATCGATTACATGTAGCGGCGACGGCCTCTCCAAGAAATACGT GTCGTGGTACCAGCAGAAGGCCGGACAGAGCCCGGTGGTGCTGATCTCAA GAGATAAGGAGCGGCCTAGCGGAATCCCGGACAGGTTCTCGGGTTCCAAC TCCGCGGACACTGCTACTCTGACCATCTCGGGGACCCAGGCTATGGACGA AGCCGATTACTACTGCCAAGCCTGGGACGACACTACTGTCGTGTTTGGAG GGGGCACCAAGTTGACCGTCCTT |

| 149366-aa VH | 1083 | QVQLVQSGAEVKKPGASVKVSCKPSGYTVTSHYIHWVRRAPGQGLEWMGM INPSGGVTAYSQTLQGRVTMTSDTSSSTVYMELSSLRSEDTAMYYCAREG SGSGWYFDFWGRGTLVTVSS |

| 149366-aa VL | 1084 | SYVLTQPPSVSVSPGQTASITCSGDGLSKKYVSWYQQKAGQSPVVLISRD KERPSGIPDRFSGSNSADTATLTISGTQAMDEADYYCQAWDDTTVVFGGG TKLTVL |

| 149366-aa Full CART | 1085 | MALPVTALLLPLALLLHAARPQVQLVQSGAEVKKPGASVKVSCKPSGYTV SHYIHWVRRAPGQGLEWMGMINPSGGVTAYSQTLQGRVTMTSDTSSSTV YMELSSLRSEDTAMYYCAREGSGSGWYFDFWGRGTLVTVSSGGGGSGGGG SGGGGSSYVLTQPPSVSVSPGQTASITCSGDGLSKKYVSWYQQKAGQSPV VLISRDKERPSGIPDRFSGSNSADTATLTISGTQAMDEADYYCQAWDDTT VVFGGGTKLTVLTTTPAPRPPTPAPTIASQPLSLRPEACRPAAGGAVHTR GLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNLG RREEYDVLDKRRGRDPEMGGKPRRKNPQEGLYNELQKDKMAEAYSEIGMK GERRRGKGHDGLYQGLSTATKDTYDALHMQALPPR |

| 149366-nt Full CAR | 1086 | ATGGCCCTCCCTGTCACCGCCCTGCTGCTTCCGCTGGCTCTTCTGCTCCA CGCCGCTCGGCCCCAAGTGCAGCTGGTGCAGAGCGGGGCCGAAGTCAAGA AGCCGGGAGCCTCCGTGAAAGTGTCCTGCAAGCCTTCGGGATACACCGTG ACCTCCCACTACATTCATTGGGTCCGCCGCGCCCCCGGCCAAGGACTCGA GTGGATGGGCATGATCAACCCTAGCGGCGGAGTGACCGCGTACAGCCAGA CGCTGCAGGGACGCGTGACTATGACCTCGGATACCTCCTCCTCCACCGTC TATATGGAACTGTCCAGCCTGCGGTCCGAGGATACCGCCATGTACTACTG CGCCCGGGAAGGATCAGGCTCCGGGTGGTATTTCGACTTCTGGGGAAGAG GCACCCTCGTGACTGTGTCATCTGGGGGAGGGGGTTCCGGTGGTGGCGGA TCGGGAGGAGGCGGTTCATCCTACGTGCTGACCCAGCCACCCTCCGTGTC CGTGAGCCCCGGCCAGACTGCATCGATTACATGTAGCGGCGACGGCCTCT CCAAGAAATACGTGTCGTGGTACCAGCAGAAGGCCGGACAGAGCCCGGTG GTGCTGATCTCAAGAGATAAGGAGCGGCCTAGCGGAATCCCGGACAGGTT CTCGGGTTCCAACTCCGCGGACACTGCTACTCTGACCATCTCGGGGACCC AGGCTATGGACGAAGCCGATTACTACTGCCAAGCCTGGGACGACACTACT GTCGTGTTTGGAGGGGGCACCAAGTTGACCGTCCTTACCACTACCCCAGC ACCGAGGCCACCCACCCCGGCTCCTACCATCGCCTCCCAGCCTCTGTCCC TGCGTCCGGAGGCATGTAGACCCGCAGCTGGTGGGGCCGTGCATACCCGG GGTCTTGACTTCGCCTGCGATATCTACATTTGGGCCCCTCTGGCTGGTAC TTGCGGGGTCCTGCTGCTTTCACTCGTGATCACTCTTTACTGTAAGCGCG GTCGGAAGAAGCTGCTGTACATCTTTAAGCAACCCTTCATGAGGCCTGTG CAGACTACTCAAGAGGAGGACGGCTGTTCATGCCGGTTCCCAGAGGAGGA GGAAGGCGGCTGCGAACTGCGCGTGAAATTCAGCCGCAGCGCAGATGCTC CAGCCTACAAGCAGGGGCAGAACCAGCTCTACAACGAACTCAATCTTGGT CGGAGAGAGGAGTACGACGTGCTGGACAAGCGGAGAGGACGGGACCCAGA AATGGGCGGGAAGCCGCGCAGAAAGAATCCCCAAGAGGGCCTGTACAACG AGCTCCAAAAGGATAAGATGGCAGAAGCCTATAGCGAGATTGGTATGAAA |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | GGGGAACGCAGAAGAGGCAAAGGCCACGACGGACTGTACCAGGGACTCAG<br>CACCGCCACCAAGGACACCTATGACGCTCTTCACATGCAGGCCCTGCCGC<br>CTCGG |

149367

| 149367-aa<br>ScFv domain | 1087 | QVQLQESGPGLVKPSQTLSLTCTVSGGSISSGGYYWSWIRQHPGKGLEWI<br>GYIYYSGSTYYNPSLKSRVTISVDTSKNQFSLKLSSVTAADTAVYYCARA<br>GIAARLRGAFDIWGQGTMVTVSSGGGGSGGGGSGGGGSDIVMTQSPSSVS<br>ASVGDRVIITCRASQGIRNWLAWYQQKPGKAPNLLIYAASNLQSGVPSRF<br>SGSGSGADFTLTISSLQPEDVATYYCQKYNSAPFTFGPGTKVDIK |
| 149367-nt<br>ScFv domain | 1088 | CAAGTGCAGCTTCAGGAGAGCGGCCCGGGACTCGTGAAGCCGTCCCAGAC<br>CCTGTCCCTGACTTGCACCGTGTCGGGAGGAAGCATCTCGAGCGGAGGCT<br>ACTATTGGTCGTGGATTCGGCAGCACCCTGGAAAGGGCCTGGAATGGATC<br>GGCTACATCTACTACTCCGGCTCGACCTACTACAACCCATCGCTGAAGTC<br>CAGAGTGACAATCTCAGTGGACACGTCCAAGAATCAGTTCAGCCTGAAGC<br>TCTCTTCCGTGACTGCGGCCGACACCGCCGTGTACTACTGCGCACGCGCT<br>GGAATTGCCGCCCGGCTGAGGGGTGCCTTCGACATTTGGGGACAGGGCAC<br>CATGGTCACCGTGTCCTCCGGCGGCGGAGGTTCCGGGGGTGGAGGCTCAG<br>GAGGAGGGGGGTCCGACATCGTCATGACTCAGTCGCCCTCAAGCGTCAGC<br>GCGTCCGTCGGGGACAGAGTGATCATCACCTGTCGGGCGTCCCAGGGAAT<br>TCGCAACTGGCTGGCCTGGTATCAGCAGAAGCCCGGAAAGGCCCCCAACC<br>TGTTGATCTACGCCGCCTCAAACCTCCAATCCGGGGTGCCGAGCCGCTTC<br>AGCGGCTCCGGTTCGGGTGCCGATTTCACTCTGACCATCTCCTCCCTGCA<br>ACCTGAAGATGTGGCTACCTACTACTGCCAAAAGTACAACTCCGCACCTT<br>TTACTTTCGGACCGGGGACCAAAGTGGACATTAAG |
| 149367-aa<br>VH | 1089 | QVQLQESGPGLVKPSQTLSLTCTVSGGSISSGGYYWSWIRQHPGKGLEWI<br>GYIYYSGSTYYNPSLKSRVTISVDTSKNQFSLKLSSVTAADTAVYYCARA<br>GIAARLRGAFDIWGQGTMVTVSS |
| 149367-aa VL | 1090 | DIVMTQSPSSVSASVGDRVIITCRASQGIRNWLAWYQQKPGKAPNLLIYA<br>ASNLQSGVPSRFSGSGSGADFTLTISSLQPEDVATYYCQKYNSAPFTFGP<br>GTKVDIK |
| 149367-aa<br>Full CAR | 1091 | MALPVTALLLPLALLLHAARPQVQLQESGPGLVKPSQTLSLTCTVSGGSI<br>SSGGYYWSWIRQHPGKGLEWIGYIYYSGSTYYNPSLKSRVTISVDTSKNQ<br>FSLKLSSVTAADTAVYYCARAGIAARLRGAFDIWGQGTMVTVSSGGGGSG<br>GGGSGGGGSDIVMTQSPSSVSASVGDRVIITCRASQGIRNWLAWYQQKPG<br>KAPNLLIYAASNLQSGVPSRFSGSGSGADFTLTISSLQPEDVATYYCQKY<br>NSAPFTFGPGTKVDIKTTTPAPRPPTPAPTIASQPLSLRPEACRPAAGGA<br>VHTRGLDFACDIYIWAPLAGTCGVLLLSLVITLYCKRGRKKLLYIFKQPF<br>MRPVQTTQEEDGCSCRFPEEEEGGCELRVKFSRSADAPAYKQGQNQLYNE<br>LNLGRREEYDVLDKRRGRDPEMGGKPRRKNPQEGLYNELQKDKMAEAYSE<br>IGMKGERRRGKGHDGLYQGLSTATKDTYDALHMQALPPR |
| 149367-nt<br>Full CAR | 1092 | ATGGCCCTCCCTGTCACCGCCCTGCTGCTTCCGCTGGCTCTTCTGCTCCA<br>CGCCGCTCGGCCCCAAGTGCAGCTTCAGGAGAGCGGCCCGGGACTCGTGA<br>AGCCGTCCCAGACCCTGTCCCTGACTTGCACCGTGTCGGGAGGAAGCATC<br>TCGAGCGGAGGCTACTATTGGTCGTGGATTCGGCAGCACCCTGGAAAGGG<br>CCTGGAATGGATCGGCTACATCTACTACTCCGGCTCGACCTACTACAACC<br>CATCGCTGAAGTCCAGAGTGACAATCTCAGTGGACACGTCCAAGAATCAG<br>TTCAGCCTGAAGCTCTCTTCCGTGACTGCGGCCGACACCGCCGTGTACTA<br>CTGCGCACGCGCTGGAATTGCCGCCCGGCTGAGGGGTGCCTTCGACATTT<br>GGGGACAGGGCACCATGGTCACCGTGTCCTCCGGCGGCGGAGGTTCCGGG<br>GGTGGAGGCTCAGGAGGAGGGGGGTCCGACATCGTCATGACTCAGTCGCC<br>CTCAAGCGTCAGCGCGTCCGTCGGGGACAGAGTGATCATCACCTGTCGGG<br>CGTCCCAGGGAATTCGCAACTGGCTGGCCTGGTATCAGCAGAAGCCCGGA<br>AAGGCCCCCAACCTGTTGATCTACGCCGCCTCAAACCTCCAATCCGGGGT<br>GCCGAGCCGCTTCAGCGGCTCCGGTTCGGGTGCCGATTTCACTCTGACCA<br>TCTCCTCCCTGCAACCTGAAGATGTGGCTACCTACTACTGCCAAAAGTAC<br>AACTCCGCACCTTTTACTTTCGGACCGGGGACCAAAGTGGACATTAAGAC<br>CACTACCCCAGCACCGAGGCCACCCACCCCGGCTCCTACCATCGCCTCCC<br>AGCCTCTGTCCCTGCGTCCGAGGCATGTAGACCCGCAGCTGGTGGGGCC<br>GTGCATACCCGGGGTCTTGACTTCGCCTGCGATATCTACATTTGGGCCCC<br>TCTGGCTGGTACTTGCGGGGTCCTGCTGCTTTCACTCGTGATCACTCTTT<br>ACTGTAAGCGCGGTCGGAAGAAGCTGCTGTACATCTTTAAGCAACCCTTC<br>ATGAGGCCTGTGCAGACTACTCAAGAGGAGGACGGCTGTTCATGCCGGTT<br>CCCAGAGGAGGAGGAAGGCGGCTGCGAACTGCGCGTGAAATTCAGCCGCA<br>GCGCAGATGCTCCAGCCTACAAGCAGGGGCAGAACCAGCTCTACAACGAA<br>CTCAATCTTGGTCGGAGAGAGGAGTACGACGTGCTGGACAAGCGGAGAGG<br>ACGGGACCCAGAAATGGGCGGGAAGCCGCGCAGAAAGAATCCCCAAGAGA |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | GCCTGTACAACGAGCTCCAAAAGGATAAGATGGCAGAAGCCTATAGCGAG<br>ATTGGTATGAAAGGGAACGCAGAAGAGGCAAAGGCCACGACGGACTGTA<br>CCAGGGACTCAGCACCGCCACCAAGGACACCTATGACGCTCTTCACATGC<br>AGGCCCTGCCGCCTCGG |

149368

| 149368-aa<br>ScFv domain | 1093 | QVQLVQSGAEVKKPGSSVKVSCKASGGTFSSYAISWVRQAPGQGLEWMGG<br>IIPIFGTANYAQKFQGRVTITADESTSTAYMELSSLRSEDTAVYYCARRG<br>GYQLLRWDVGLLRSAFDIWGQGTMVTVSSGGGGSGGGGSGGGGSSYVLTQ<br>PPSVSVAPGQTARITCGGNNIGSKSVHWYQQKPGQAPVLVLYGKNNRPSG<br>VPDRFSGSRSGTTASLTITGAQAEDEADYYCSSRDSSGDHLRVFGTGTKV<br>TVL |
| 149368-nt<br>ScFv domain | 1094 | CAAGTGCAGCTGGTCCAGTCGGGCGCCGAGGTCAAGAAGCCCGGGAGCTC<br>TGTGAAAGTGTCCTGCAAGGCCTCCGGGGGCACCTTTAGCTCCTACGCCA<br>TCTCCTGGGTCCGCCAAGCACCGGGTCAAGGCCTGGAGTGGATGGGGGGA<br>ATTATCCCTATCTTCGGCACTGCCAACTACGCCCAGAAGTTCCAGGGACG<br>CGTGACCATTACCGCGGACGAATCCACCTCCACCGCTTATATGGAGCTGT<br>CCAGCTTGCGCTCGGAAGATACCGCCGTGTACTACTGCGCCCGGAGGGGT<br>GGATACCAGCTGCTGAGATGGGACGTGGGCCTCCTGCGGTCGGCGTTCGA<br>CATCTGGGGCCAGGGCACTATGGTCACTGTGTCCAGCGGAGGAGGCGGAT<br>CGGGAGGCGGCGGATCAGGGGGAGGCGGTTCCAGCTACGTGCTTACTCAA<br>CCCCCTTCGGTGTCCGTGGCCCCGGGACAGACCGCCAGAATCACTTGCGG<br>AGGAAACAACATTGGGTCCAAGAGCGTGCATTGGTACCAGCAGAAGCCAG<br>GACAGGCCCCTGTGCTGGTGCTCTACGGGAAGAACAATCGGCCCAGCGGA<br>GTGCCGGACAGGTTCTCGGGTTCACGCTCCGGTACAACCGCTTCACTGAC<br>TATCACCGGGGCCCAGGCAGAGGATGAAGCGGACTACTACTGTTCCTCCC<br>GGGATTCATCCGGCGACCACCTCCGGGTGTTCGGAACCGGAACGAAGGTC<br>ACCGTGCTG |
| 149368-aa<br>VH | 1095 | QVQLVQSGAEVKKPGSSVKVSCKASGGTFSSYAISWVRQAPGQGLEWMGG<br>IIPIFGTANYAQKFQGRVTITADESTSTAYMELSSLRSEDTAVYYCARRG<br>GYQLLRWDVGLLRSAFDIWGQGTMVTVSS |
| 149368-aa VL | 1096 | SYVLTQPPSVSVAPGQTARITCGGNNIGSKSVHWYQQKPGQAPVLVLYGK<br>NNRPSGVPDRFSGSRSGTTASLTITGAQAEDEADYYCSSRDSSGDHLRVF<br>GTGTKVTVL |
| 149368-aa<br>Full CAR | 1097 | MALPVTALLLPLALLLHAARPQVQLVQSGAEVKKPGSSVKVSCKASGGTF<br>SSYAISWVRQAPGQGLEWMGGIIPIFGTANYAQKFQGRVTITADESTSTA<br>YMELSSLRSEDTAVYYCARRGGYQLLRWDVGLLRSAFDIWGQGTMVTVSS<br>GGGGSGGGGSGGGGSSYVLTQPPSVSVAPGQTARITCGGNNIGSKSVHWY<br>QQKPGQAPVLVLYGKNNRPSGVPDRFSGSRSGTTASLTITGAQAEDEADY<br>YCSSRDSSGDHLRVFGTGTKVTVLTTTPAPRPPTPAPTIASQPLSLRPEA<br>CRPAAGGAVHTRGLDFACDIYIWAPLAGTCGVLLLSLVITLYCKRGRKKL<br>LYIFKQPFMRPVQTTQEEDGCSCRFPEEEEGGCELRVKFSRSADAPAYKQ<br>GQNQLYNELNLGRREEYDVLDKRRGRDPEMGGKPRRKNPQEGLYNELQKD<br>KMAEAYSEIGMKGERRRGKGHDGLYQGLSTATKDTYDALHMQALPPR |
| 149368-nt<br>Full CAR | 1098 | ATGGCCCTCCCTGTCACCGCCCTGCTGCTTCCGCTGGCTCTTCTGCTCCA<br>CGCCGCTCGGCCCCAAGTGCAGCTGGTCCAGTCGGGCGCCGAGGTCAAGA<br>AGCCCGGGAGCTCTGTGAAAGTGTCCTGCAAGGCCTCCGGGGGCACCTTT<br>AGCTCCTACGCCATCTCCTGGGTCCGCCAAGCACCGGGTCAAGGCCTGGA<br>GTGGATGGGGGGAATTATCCCTATCTTCGGCACTGCCAACTACGCCCAGA<br>AGTTCCAGGGACGCGTGACCATTACCGCGGACGAATCCACCTCCACCGCT<br>TATATGGAGCTGTCCAGCTTGCGCTCGGAAGATACCGCCGTGTACTACTG<br>CGCCCGGAGGGGTGGATACCAGCTGCTGAGATGGGACGTGGGCCTCCTGC<br>GGTCGGCGTTCGACATCTGGGGCCAGGGCACTATGGTCACTGTGTCCAGC<br>GGAGGAGGCGGATCGGGAGGCGGCGGATCAGGGGGAGGCGGTTCCAGCTA<br>CGTGCTTACTCAACCCCCTTCGGTGTCCGTGGCCCCGGGACAGACCGCCA<br>GAATCACTTGCGGAGGAAACAACATTGGGTCCAAGAGCGTGCATTGGTAC<br>CAGCAGAAGCCAGGACAGGCCCCTGTGCTGGTGCTCTACGGGAAGAACAA<br>TCGGCCCAGCGGAGTGCCGGACAGGTTCTCGGGTTCACGCTCCGGTACAA<br>CCGCTTCACTGACTATCACCGGGGCCCAGGCAGAGGATGAAGCGGACTAC<br>TACTGTTCCTCCCGGGATTCATCCGGCGACCACCTCCGGGTGTTCGGAAC<br>CGGAACGAAGGTCACCGTGCTGACCACTACCCCAGCACCGAGGCCACCCA<br>CCCCGGCTCCTACCATCGCCTCCCAGCCTCTGTCCCTGCGTCCGGAGGCA<br>TGTAGACCCGCAGCTGGTGGGCCGTGCATACCCGGGGTCTTGACTTCGC<br>CTGCGATATCTACATTTGGGCCCCTCTGGCTGGTACTTGCGGGGTCCTGC<br>TGCTTTCACTCGTGATCACTCTTTACTGTAAGCGCGGTCGGAAGAAGCTG<br>CTGTACATCTTTAAGCAACCCTTCATGAGGCCTGTGCAGACTACTCAAGA<br>GGAGGACGGCTGTTCATGCCGGTTCCCAGAGGAGGAGGAAGGCGGCTGCG |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | AACTGCGCGTGAAATTCAGCCGCAGCGCAGATGCTCCAGCCTACAAGCAG<br>GGGCAGAACCAGCTCTACAACGAACTCAATCTTGGTCGGAGAGAGGAGTA<br>CGACGTGCTGGACAAGCGGAGAGGACGGGACCCAGAAATGGGCGGGAAGC<br>CGCGCAGAAAGAATCCCCAAGAGGGCCTGTACAACGAGCTCCAAAAGGAT<br>AAGATGGCAGAAGCCTATAGCGAGATTGGTATGAAAGGGGAACGCAGAAG<br>AGGCAAAGGCCACGACGGACTGTACCAGGGACTCAGCACCGCCACCAAGG<br>ACACCTATGACGCTCTTCACATGCAGGCCCTGCCGCCTCGG |
| | | 149369 |
| 149369-aa<br>ScFv domain | 1099 | EVQLQQSGPGLVKPSQTLSLTCAISGDSVSSNSAAWNWIRQSPSRGLEWL<br>GRTYYRSKWYSFYAISLKSRIIINPDTSKNQFSLQLKSVTPEDTAVYYCA<br>RSSPEGLFLYWFDPWGQGTLVTVSSGGDGSGGGGSGGGGSSSELTQDPAV<br>SVALGQTIRITCQGDSLGNYYATWYQQKPGQAPVLVIYGTNNRPSGIPDR<br>FSASSSGNTASLTITGAQAEDEADYYCNSRDSSGHHLLFGTGTKVTVL |
| 149369-nt<br>ScFv domain | 1100 | GAAGTGCAGCTCCAACAGTCAGGACCGGGGCTCGTGAAGCCATCCCAGAC<br>CCTGTCCCTGACTTGTGCCATCTCGGGAGATAGCGTGTCATCGAACTCCG<br>CCGCCTGGAACTGGATTCGGCAGAGCCCGTCCCGCGGACTGGAGTGGCTT<br>GGAAGGACCTACTACCGGTCCAAGTGGTACTCTTTCTACGCGATCTCGCT<br>GAAGTCCCGCATTATCATTAACCCTGATACCTCCAAGAATCAGTTCTCCC<br>TCCAACTGAAATCCGTCACCCCCGAGGACACAGCAGTGTATTACTGCGCA<br>CGGAGCAGCCCCGAAGGACTGTTCCTGTATTGGTTTGACCCCTGGGGCCA<br>GGGGACTCTTGTGACCGTGTCGAGCGGCGGAGATGGGTCCGGTGGCGGTG<br>GTTCGGGGGGCGGCGGATCATCATCCGAACTGACCCAGGACCCGGCTGTG<br>TCCGTGGCGCTGGGACAAACCATCCGCATTACGTGCCAGGGAGACTCCCT<br>GGGCAACTACTACGCCACTTGGTACCAGCAGAAGCCGGGCCAAGCCCCTG<br>TGTTGGTCATCTACGGGACCAACAACAGACCTTCCGGCATCCCCGACCGG<br>TTCAGCGCTTCGTCCTCCGGCAACACTGCCAGCCTGACCATCACTGGAGC<br>GCAGGCCGAAGATGAGGCCGACTACTACTGCAACAGCAGAGACTCCTCGG<br>GTCATCACCTCTTGTTCGGAACTGGAACCAAGGTCACCGTGCTG |
| 149369-aa<br>VH | 1101 | EVQLQQSGPGLVKPSQTLSLTCAISGDSVSSNSAAWNWIRQSPSRGLEWL<br>GRTYYRSKWYSFYAISLKSRIIINPDTSKNQFSLQLKSVTPEDTAVYYCA<br>RSSPEGLFLYWFDPWGQGTLVTVSS |
| 149369-aa VL | 1102 | SSELTQDPAVSVALGQTIRITCQGDSLGNYYATWYQQKPGQAPVLVIYGT<br>NNRPSGIPDRFSASSSGNTASLTITGAQAEDEADYYCNSRDSSGHHLLFG<br>TGTKVTVL |
| 149369-aa<br>Full CAR | 1103 | MALPVTALLLPLALLLHAARPEVQLQQSGPGLVKPSQTLSLTCAISGDSV<br>SSNSAAWNWIRQSPSRGLEWLGRTYYRSKWYSFYAISLKSRIIINPDTSK<br>NQFSLQLKSVTPEDTAVYYCARSSPEGLFLYWFDPWGQGTLVTVSSGGDG<br>SGGGGSGGGGSSSELTQDPAVSVALGQTIRITCQGDSLGNYYATWYQQKP<br>GQAPVLVIYGTNNRPSGIPDRFSASSSGNTASLTITGAQAEDEADYYCNS<br>RDSSGHHLLFGTGTKVTVLTTTPAPRPPTPAPTIASQPLSLRPEACRPAA<br>GGAVHTRGLDFACDIYIWAPLAGTCGVLLLSLVITLYCKRGRKKLLYIFK<br>QPFMRPVQTTQEEDGCSCRFPEEEEGGCELRVKFSRSADAPAYKQGQNQL<br>YNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| 149369-nt<br>Full CAR | 1104 | ATGGCCCTCCCTGTCACCGCCCTGCTGCTTCCGCTGGCTCTTCTGCTCCA<br>CGCCGCTCGGCCCGAAGTGCAGCTCCAACAGTCAGGACCGGGGCTCGTGA<br>AGCCATCCCAGACCCTGTCCCTGACTTGTGCCATCTCGGGAGATAGCGTG<br>TCATCGAACTCCGCCGCCTGGAACTGGATTCGGCAGAGCCCGTCCCGCGG<br>ACTGGAGTGGCTTGGAAGGACCTACTACCGGTCCAAGTGGTACTCTTTCT<br>ACGCGATCTCGCTGAAGTCCCGCATTATCATTAACCCTGATACCTCCAAG<br>AATCAGTTCTCCCTCCAACTGAAATCCGTCACCCCCGAGGACACAGCAGT<br>GTATTACTGCGCACGGAGCAGCCCCGAAGGACTGTTCCTGTATTGGTTTG<br>ACCCCTGGGGCCAGGGGACTCTTGTGACCGTGTCGAGCGGCGGAGATGGG<br>TCCGGTGGCGGTGGTTCGGGGGGCGGCGGATCATCATCCGAACTGACCCA<br>GGACCCGGCTGTGTCCGTGGCGCTGGGACAAACCATCCGCATTACGTGCC<br>AGGGAGACTCCCTGGGCAACTACTACGCCACTTGGTACCAGCAGAAGCCG<br>GGCCAAGCCCCTGTGTTGGTCATCTACGGGACCAACAACAGACCTTCCGG<br>CATCCCCGACCGGTTCAGCGCTTCGTCCTCCGGCAACACTGCCAGCCTGA<br>CCATCACTGGAGCGCAGGCCGAAGATGAGGCCGACTACTACTGCAACAGC<br>AGAGACTCCTCGGGTCATCACCTCTTGTTCGGAACTGGAACCAAGGTCAC<br>CGTGCTGACCACTACCCCAGCACCGAGGCCACCCACCCCGGCTCCTACCA<br>TCGCCTCCCAGCCTCTGTCCCTGCGTCCGGAGGCATGTAGACCCGCAGCT<br>GGTGGGGCCGTGCATACCCGGGGTCTTGACTTCGCCTGCGATATCTACAT<br>TTGGGCCCCTCTGGCTGGTACTTGCGGGGTCCTGCTGCTTTCACTCGTGA<br>TCACTCTTTACTGTAAGCGCGGTCGGAAGAAGCTGCTGTACATCTTTAAG<br>CAACCCTTCATGAGGCCTGTGCAGACTACTCAAGAGGAGGACGGCTGTTC |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | ATGCCGGTTCCCAGAGGAGGAGGAAGGCGGCTGCGAACTGCGCGTGAAAT<br>TCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAA<br>GCGGAGAGGACGGGACCCAGAAATGGGCGGGAAGCCGCGCAGAAAGAATC<br>CCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGA<br>CGGACTGTACCAGGGACTCAGCACCGCCACCAAGGACACCTATGACGCTC<br>TTCACATGCAGGCCCTGCCGCCTCGG |
| | | BCMA_EBB-C1978-A4 |
| BCMA_EBB-<br>C1978-A4-<br>aa<br>ScFv domain | 1105 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVE<br>GSGSLDYWGQGTLVTVSSGGGGSGGGGSGGGGSEIVMTQSPGTLSLSPGE<br>RATLSCRASQSVSSAYLAWYQQKPGQPPRLLISGASTRATGIPDRFGGSG<br>SGTDFTLTISRLEPEDFAVYYCQHYGSSFNGSSLFTFGQGTRLEIK |
| BCMA_EBB-<br>C1978-A4-nt<br>ScFv domain | 1106 | GAAGTGCAGCTCGTGGAGTCAGGAGGCGGCCTGGTCCAGCCGGGAGGGTC<br>CCTTAGACTGTCATGCGCCGCAAGCGGATTCACTTTCTCCTCCTATGCCA<br>TGAGCTGGGTCCGCCAAGCCCCCGGAAAGGGACTGGAATGGGTGTCCGCC<br>ATCTCGGGGTCTGGAGGCTCAACTTACTACGCTGACTCCGTGAAGGGACG<br>GTTCACCATTAGCCGCGACAACTCCAAGAACACCCTCTACCTCCAAATGA<br>ACTCCCTGCGGGCCGAGGATACCGCCGTCTACTACTGCGCCAAAGTGGAA<br>GGTTCAGGATCGCTGGACTACTGGGGACAGGGTACTCTCGTGACCGTGTC<br>ATCGGGCGGAGGAGGTTCCGGCGGTGGCGGCTCCGGCGGCGGAGGGTCGG<br>AGATCGTGATGACCCAGAGCCCTGGTACTCTGAGCCTTTCGCCGGGAGAA<br>AGGGCCACCCTGTCCTGCCGCGCTTCCCAATCCGTGTCCTCCGCGTACTT<br>GGCGTGGTACCAGCAGAAGCCGGGACAGCCCCCTCGGCTGCTGATCAGCG<br>GGGCCAGCACCCGGGCAACCGGAATCCCAGACAGATTCGGGGGTTCCGGC<br>AGCGGCACAGATTTCACCCTGACTATTTCGAGGTTGGAGCCCGAGGACTT<br>TGCGGTGTATTACTGTCAGCACTACGGGTCGTCCTTTAATGGCTCCAGCC<br>TGTTCACGTTCGGACAGGGGACCCGCCTGGAAATCAAG |
| BCMA_EBB-<br>C1978-A4-<br>aa<br>VH | 1107 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVE<br>GSGSLDYWGQGTLVTVSS |
| BCMA_EBB-<br>C1978-A4-<br>aa<br>VL | 1108 | EIVMTQSPGTLSLSPGERATLSCRASQSVSSAYLAWYQQKPGQPPRLLIS<br>GASTRATGIPDRFGGSGSGTDFTLTISRLEPEDFAVYYCQHYGSSFNGSS<br>LFTFGQGTRLEIK |
| BCMA_EBB-<br>C1978-A4-<br>aa<br>Full CART | 1109 | MALPVTALLLPLALLLHAARPEVQLVESGGGLVQPGGSLRLSCAASGFTF<br>SSYAMSWVRQAPGKGLEWVSAISGSGGSTYYADSVKGRFTISRDNSKNTL<br>YLQMNSLRAEDTAVYYCAKVEGSGSLDYWGQGTLVTVSSGGGGSGGGGSG<br>GGGSEIVMTQSPGTLSLSPGERATLSCRASQSVSSAYLAWYQQKPGQPPR<br>LLISGASTRATGIPDRFGGSGSGTDFTLTISRLEPEDFAVYYCQHYGSSF<br>NGSSLFTFGQGTRLEIKTTTPAPRPPTPAPTIASQPLSLRPEACRPAAGG<br>AVHTRGLDFACDIYIWAPLAGTCGVLLLSLVITLYCKRGRKKLLYIFKQP<br>FMRPVQTTQEEDGCSCRFPEEEEGGCELRVKFSRSADAPAYKQGQNQLYN<br>ELNLGRREEYDVLDKRRGRDPEMGGKPRRKNPQEGLYNELQKDKMAEAYS<br>EIGMKGERRRGKGHDGLYQGLSTATKDTYDALHMQALPPR |
| BCMA_EBB-<br>C1978-A4-nt<br>Full CART | 1110 | ATGGCCCTCCCTGTCACCGCCCTGCTGCTTCCGCTGGCTCTTCTGCTCCA<br>CGCCGCTCGGCCCGAAGTGCAGCTCGTGGAGTCAGGAGGCGGCCTGGTCC<br>AGCCGGGAGGGTCCCTTAGACTGTCATGCGCCGCAAGCGGATTCACTTTC<br>TCCTCCTATGCCATGAGCTGGGTCCGCCAAGCCCCCGGAAAGGGACTGGA<br>ATGGGTGTCCGCCATCTCGGGGTCTGGAGGCTCAACTTACTACGCTGACT<br>CCGTGAAGGGACGGTTCACCATTAGCCGCGACAACTCCAAGAACACCCTC<br>TACCTCCAAATGAACTCCCTGCGGGCCGAGGATACCGCCGTCTACTACTG<br>CGCCAAAGTGGAAGGTTCAGGATCGCTGGACTACTGGGGACAGGGTACTC<br>TCGTGACCGTGTCATCGGGCGGAGGAGGTTCCGGCGGTGGCGGCTCCGGC<br>GGCGGAGGGTCGGAGATCGTGATGACCCAGAGCCCTGGTACTCTGAGCCT<br>TTCGCCGGGAGAAAGGGCCACCCTGTCCTGCCGCGCTTCCCAATCCGTGT<br>CCTCCGCGTACTTGGCGTGGTACCAGCAGAAGCCGGGACAGCCCCCTCGG<br>CTGCTGATCAGCGGGGCCAGCACCCGGGCAACCGGAATCCCAGACAGATT<br>CGGGGGTTCCGGCAGCGGCACAGATTTCACCCTGACTATTTCGAGGTTGG<br>AGCCCGAGGACTTTGCGGTGTATTACTGTCAGCACTACGGGTCGTCCTTT<br>AATGGCTCCAGCCTGTTCACGTTCGGACAGGGGACCCGCCTGGAAATCAA<br>GACCACTACCCCAGCACCGAGGCCACCCACCCCGGCTCCTACCATCGCCT<br>CCCAGCCTCTGTCCCTGCGTCCGGAGGCATGTAGACCCGCAGCTGGTGGG<br>GCCGTGCATACCCGGGGTCTTGACTTCGCCTGCGATATCTACATTTGGGC |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | CCCTCTGGCTGGTACTTGCGGGGTCCTGCTGCTTTCACTCGTGATCACTC<br>TTTACTGTAAGCGCGGTCGGAAGAAGCTGCTGTACATCTTTAAGCAACCC<br>TTCATGAGGCCTGTGCAGACTACTCAAGAGGAGGACGGCTGTTCATGCCG<br>GTTCCCAGAGGAGGAGGAAGGCGGCTGCGAACTGCGCGTGAAATTCAGCC<br>GCAGCGCAGATGCTCCAGCCTACAAGCAGGGGCAGAACCAGCTCTACAAC<br>GAACTCAATCTTGGTCGGAGAGAGGAGTACGACGTGCTGGACAAGCGGAG<br>AGGACGGGACCCAGAAATGGGCGGGAAGCCGCGCAGAAAGAATCCCCAAG<br>AGGGCCTGTACAACGAGCTCCAAAAGGATAAGATGGCAGAAGCCTATAGC<br>GAGATTGGTATGAAAGGGGAACGCAGAAGAGGCAAAGGCCACGACGGACT<br>GTACCAGGGACTCAGCACCGCCACCAAGGACACCTATGACGCTCTTCACA<br>TGCAGGCCCTGCCGCCTCGG |

BCMA_EBB-C1978-G1

| BCMA_EBB-<br>C1978-G1-<br>aa<br>ScFv domain | 1111 | EVQLVETGGGLVQPGGSLRLSCAASGITFSRYPMSWVRQAPGKGL<br>EWVSGISDSGVSTYYADSAKGRFTISRDNSKNTLFLQMSSLRDEDT<br>AVYYCVTRAGSEASDIVVGQGTMVTVSSGGGGSGGGGSGGGGSEI<br>VLTQSPATLSLSPGERATLSCRASQSVSNSLAWYQQKPGQAPRLLI<br>YDASSRATGIPDRFSGSGSGTDFTLTISRLEPEDFAIYYCQQFGTSSG<br>LTFGGGTKLEIK |
| BCMA_EBB-<br>C1978-G1-<br>nt<br>ScFv domain | 1112 | GAAGTGCAACTGGTGGAAACCGGTGGCGGCCTGGTGCAGCCTGGAGGATC<br>ATTGAGGCTGTCATGCGCGGCCAGCGGTATTACCTTCTCCCGGTACCCCA<br>TGTCCTGGGTCAGACAGGCCCCGGGGAAAGGGCTTGAATGGGTGTCCGGG<br>ATCTCGGACTCCGGTGTCAGCACTTACTACGCCGACTCCGCCAAGGGACG<br>CTTCACCATTTCCCGGGACAACTCGAAGAACACCCTGTTCCTCCAAATGA<br>GCTCCCTCCGGGACGAGGATACTGCAGTGTACTACTGCGTGACCCGCGCC<br>GGGTCCGAGGCGTCTGACATTGTGGACAGGGCACTATGGTCACCGTGTC<br>GTCCGGCGGAGGGGGCTCGGGAGGCGGTGGCAGCGGAGGAGGAGGGTCCG<br>AGATCGTGCTGACCCAATCCCCGGCCACCCTCTCGCTGAGCCCTGGAGAA<br>AGGGCAACCTTGTCCTGTCGCGCGAGCCAGTCCGTGAGCAACTCCCTGGC<br>CTGGTACCAGCAGAAGCCCGGACAGGCTCCGAGACTTCTGATCTACGACG<br>CTTCGAGCCGGGCCACTGGAATCCCCGACCGCTTTTCGGGGTCCGGCTCA<br>GGAACCGATTTCACCCTGACAATCTCACGGCTGGAGCCAGAGGATTCGC<br>CATCTATTACTGCCAGCAGTTCGGTACTTCCTCCGGCCTGACTTTCGGAG<br>GCGGCACGAAGCTCGAAATCAAG |
| BCMA_EBB-<br>C1978-G1-<br>aa<br>VH | 1113 | EVQLVETGGGLVQPGGSLRLSCAASGITFSRYPMSWVRQAPGKGLEWVSG<br>ISDSGVSTYYADSAKGRFTISRDNSKNTLFLQMSSLRDEDTAVYYCVTRA<br>GSEASDIWGQGTMVTVSS |
| BCMA_EBB-<br>C1978-G1-<br>aa<br>VL | 1114 | EIVLTQSPATLSLSPGERATLSCRASQSVSNSLAWYQQKPGQAPRLLIYD<br>ASSRATGIPDRFSGSGSGTDFTLTISRLEPEDFAIYYCQQFGTSSGLTFG<br>GGTKLEIK |
| BCMA_EBB-<br>C1978-G1-<br>aa<br>Full CART | 1115 | MALPVTALLLPLALLLHAARPEVQLVETGGGLVQPGGSLRLSCAA<br>SGITFSRYPMSWVRQAPGKGLEWVSGISDSGVSTYYADSAKGRFTI<br>SRDNSKNTLFLQMSSLRDEDTAVYYCVTRAGSEASDIWGQGTMV<br>TVSSGGGGSGGGGSGGGGSEIVLTQSPATLSLSPGERATLSCRASQ<br>SVSNSLAWYQQKPGQAPRLLIYDASSRATGIPDRFSGSGSGTDFTL<br>TISRLEPEDFAIYYCQQFGTSSGLTFGGGTKLEIKTTTPAPRPPTPAP<br>TIASQPLSLRPEACRPAAGGAVHTRGLDFACDIYIWAPLAGTCGVL<br>LLSLVITLYCKRGRKKLLYIFKQPFMRPVQTTQEEDGCSCRFPEEEE<br>GGCELRVKFSRSADAPAYKQGQNQLYNELNLGRREEYDVLDKRR<br>GRDPEMGGKPRRKNPQEGLYNELQKDKMAEAYSEIGMKGERRRG<br>KGHDGLYQGLSTATKDTYDALHMQALPPR |
| BCMA_EBB-<br>C1978-G1-<br>nt<br>Full CART | 1116 | ATGGCCCTCCCTGTCACCGCCCTGCTGCTTCCGCTGGCTCTTCTGCTCCA<br>CGCCGCTCGGCCCGAAGTGCAACTGGTGGAAACCGGTGGCGGCCTGGTGC<br>AGCCTGGAGGATCATTGAGGCTGTCATGCGCGGCCAGCGGTATTACCTTC<br>TCCCGGTACCCCATGTCCTGGGTCAGACAGGCCCCGGGGAAAGGGCTTGA<br>ATGGGTGTCCGGGATCTCGGACTCCGGTGTCAGCACTTACTACGCCGACT<br>CCGCCAAGGGACGCTTCACCATTTCCCGGGACAACTCGAAGAACACCCTG<br>TTCCTCCAAATGAGCTCCCTCCGGGACGAGGATACTGCAGTGTACTACTG<br>CGTGACCCGCGCCGGGTCCGAGGCGTCTGACATTGTGGGACAGGGCACTA<br>TGGTCACCGTGTCGTCCGGCGGAGGGGGCTCGGGAGGCGGTGGCAGCGGA<br>GGAGGAGGGTCCGAGATCGTGCTGACCCAATCCCCGGCCACCCTCTCGCT<br>GAGCCCTGGAGAAAGGGCAACCTTGTCCTGTCGCGCGAGCCAGTCCGTGA<br>GCAACTCCCTGGCCTGGTACCAGCAGAAGCCCGGACAGGCTCCGAGACTT<br>CTGATCTACGACGCTTCGAGCCGGGCCACTGGAATCCCCGACCGCTTTTC<br>GGGGTCCGGCTCAGGAACCGATTTCACCCTGACAATCTCACGGCTGGAGC |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | CAGAGGATTTCGCCATCTATTACTGCCAGCAGTTCGGTACTTCCTCCGGC<br>CTGACTTTCGGAGGCGGCACGAAGCTCGAAATCAAGACCACTACCCCAGC<br>ACCGAGGCCACCCACCCCGGCTCCTACCATCGCCTCCCAGCCTCTGTCCC<br>TGCGTCCGGAGGCATGTAGACCCGCAGCTGGTGGGGCCGTGCATACCCGG<br>GGTCTTGACTTCGCCTGCGATATCTACATTTGGGCCCCTCTGGCTGGTAC<br>TTGCGGGGTCCTGCTCGTCTTTCACTCGTGATCACTCTTTACTGTAAGCGCG<br>GTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGA<br>GGAAGGCGGCTGCGAACTGCGCGTGAAATTCAGCCGCAGCCAGATGCTC<br>CAGCCTACAAGCAGGGGCAGAACCAGCTCTACAACGAACTCAATCTTGGT<br>CGGAGAGAGGAGTACGACGTGCTGGACAAGCGGAGAGGACGGGACCCAGA<br>ATGGGCGGGAAGCCGCGCAGAAAGAATCCCCAAGAGGGCCTGTACAACG<br>AGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAG<br>CACCGCCACCAAGGACACCTATGACGCTCTTCACATGCAGGCCCTGCCGC<br>CTCGG |
| | | BCMA_EBB-C1979-C1 |
| BCMA_EBB-<br>C1979-C1-<br>aa<br>ScFv domain | 1117 | QVQLVESGGGLVQPGGSLRLSCAASGFTFSSYAMSWVRQAPGKGLEWVSA<br>ISGSGGSTYYADSVKGRFTISRDNAKNSLYLQMNSLRAEDTAIYYCARAT<br>YKRELRYYYGMDVWGQGTMVTVSSGGGGSGGGGSGGGGSEIVMTQSPGTV<br>SLSPGERATLSCRASQSVSSSFLAWYQQKPGQAPRLLIYGASSRATGIPD<br>RFSGSGSGTDFTLTISRLEPEDSAVYYCQQYHSSPSWTFGQGTRLEIK |
| BCMA_EBB-<br>C1979-C1-nt<br>ScFv domain | 1118 | CAAGTGCAGCTCGTGGAATCGGGTGGCGGACTGGTGCAGCCGGGGGGCTC<br>ACTTAGACTGTCCTGCGCGGCCAGCGGATTCACTTTCTCCTCCTACGCCA<br>TGTCCTGGGTCAGACAGGCCCCTGGAAAGGGCCTGGAATGGGTGTCCGCA<br>ATCAGCGGCAGCGGCGGCTCGACCTATTACGCGGATTCAGTGAAGGGCAG<br>ATTCACCATTTCCCGGGACAACGCCAAGAACTCCTTGTACCTTCAAATGA<br>ACTCCCTCCGCGCGGAAGATACCGCAATCTACTACTGCGCTCGGGCCACT<br>TACAAGAGGGAACTGCGCTACTACTACGGGATGGACGTCTGGGGCCAGGG<br>AACCATGGTCACCGTGTCCAGCGGAGGAGGAGGATCGGGAGGAGGCGGTA<br>GCGGGGGTGGAGGGTCGGAGATCGTGATGACCCAGTCCCCCGGCACTGTG<br>TCGCTGTCCCCCGGCGAACGGGCCACCCTGTCATGTCGGGCCAGCCAGTC<br>AGTGTCGTCAAGCTTCCTCGCCTGGTACCAGCAGAAACCGGGACAAGCTC<br>CCCGCCTGCTGATCTACGGAGCCAGCAGCCGGGCCACCGGTATTCCTGAC<br>CGGTTCTCCGGTTCGGGTCCGGGACCGACTTTACTCTGACTATCTCTCG<br>CCTCGAGCCAGAGGACTCCGCCGTGTATTACTGCCAGCAGTACCACTCCT<br>CCCCGTCCTGGACGTTCGGACAGGGCACAAGGCTGGAGATTAAG |
| BCMA_EBB-<br>C1979-C1-<br>aa<br>VH | 1119 | QVQLVESGGGLVQPGGSLRLSCAASGFTFSSYAMSWVRQAPGKGLEWVSA<br>ISGSGGSTYYADSVKGRFTISRDNAKNSLYLQMNSLRAEDTAIYYCARAT<br>YKRELRYYYGMDVWGQGTMVTVSS |
| BCMA_EBB-<br>C1979-C1-<br>aa<br>VL | 1120 | EIVMTQSPGTVSLSPGERATLSCRASQSVSSSFLAWYQQKPGQAPRLLIY<br>GASSRATGIPDRFSGSGSGTDFTLTISRLEPEDSAVYYCQQYHSSPSWTF<br>GQGTRLEIK |
| BCMA_EBB-<br>C1979-C1-<br>aa<br>Full CART | 1121 | MALPVTALLLPLALLLHAARPQVQLVESGGGLVQPGGSLRLSCAASGFTF<br>SSYAMSWVRQAPGKGLEWVSAISGSGGSTYYADSVKGRFTISRDNAKNSL<br>YLQMNSLRAEDTAIYYCARATYKRELRYYYGMDVWGQGTMVTVSSGGGGS<br>GGGGSGGGGSEIVMTQSPGTVSLSPGERATLSCRASQSVSSSFLAWYQQK<br>PGQAPRLLIYGASSRATGIPDRFSGSGSGTDFTLTISRLEPEDSAVYYCQ<br>QYHSSPSWTFGQGTRLEIKTTTPAPRPPTPAPTIASQPLSLRPEACRPAA<br>GGAVHTRGLDFACDIYIWAPLAGTCGVLLLSLVITLYCKRGRKKLLYIFK<br>QPFMRPVQTTQEEDGCSCRFPEEEEGGCELRVKFSRSADAPAYKQGQNQL<br>YNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| BCMA_EBB-<br>C1979-C1-nt<br>Full CART | 1122 | ATGGCCCTCCCTGTCACCGCCCTGCTGCTTCCGCTGGCTCTTCTGCTCCA<br>CGCCGCTCGGCCCCAAGTGCAGCTCGTGGAATCGGGTGGCGGACTGGTGC<br>AGCCGGGGGGCTCACTTAGACTGTCCTGCGCGGCCAGCGGATTCACTTTC<br>TCCTCCTACGCCATGTCCTGGGTCAGACAGGCCCCTGGAAAGGGCCTGGA<br>ATGGGTGTCCGCAATCAGCGGCAGCGGCGGCTCGACCTATTACGCGGATT<br>CAGTGAAGGGCAGATTCACCATTTCCCGGGACAACGCCAAGAACTCCTTG<br>TACCTTCAAATGAACTCCCTCCGCGCGGAAGATACCGCAATCTACTACTG<br>CGCTCGGGCCACTTACAAGAGGGAACTGCGCTACTACTACGGGATGGACG<br>TCTGGGGCCAGGGAACCATGGTCACCGTGTCCAGCGGAGGAGGAGGATCG<br>GGAGGAGGCGGTAGCGGGGGTGGAGGGTCGGAGATCGTGATGACCCAGTC<br>CCCCGGCACTGTGTCGCTGTCCCCCGGCGAACGGGCCACCCTGTCATGTC |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | GGGCCAGCCAGTCAGTGTCGTCAAGCTTCCTCGCCTGGTACCAGCAGAAA<br>CCGGGACAAGCTCCCCGCCTGCTGATCTACGGAGCCAGCAGCCGGGCCAC<br>CGGTATTCCTGACCGGTTCTCCGGTTCGGGGTCCGGGACCGACTTTACTC<br>TGACTATCTCTCGCCTCGAGCCAGAGGACTCCGCCGTGTATTACTGCCAG<br>CAGTACCACTCCTCCCCGTCCTGGACGTTCGGACAGGGCACAAGGCTGGA<br>GATTAAGACCACTACCCCAGCACCGAGGCCACCCACCCCGGCTCCTACCA<br>TCGCCTCCCAGCCTCTGTCCCTGCGTCCGGAGGCATGTAGACCCGCAGCT<br>GGTGGGGCCGTGCATACCCGGGGTCTTGACTTCGCCTGCGATATCTACAT<br>TTGGGCCCCTCTGGCTGGTACTTGCGGGGTCCTGCTGCTTTCACTCGTGA<br>TCACTCTTTACTGTAAGCGCGGTCGGAAGAAGCTGCTGTACATCTTTAAG<br>CAACCCTTCATGAGGCCTGTGCAGACTACTCAAGAGGAGGACGGCTGTTC<br>ATGCCGGTTCCCAGAGGAGGAGGAAGGCGGCTGCGAACTGCGCGTGAAAT<br>TCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAA<br>GCGGAGAGGACGGGACCCAGAAATGGGCGGGAAGCCGCGCAGAAAGAATC<br>CCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGA<br>CGGACTGTACCAGGGACTCAGCACCGCCACCAAGGACACCTATGACGCTC<br>TTCACATGCAGGCCCTGCCGCCTCGG |
| | | BCMA_EBB-C1978-C7 |
| BCMA_EBB-<br>C1978-C7-<br>aa<br>ScFv domain | 1123 | EVQLVETGGGLVQPGGSLRLSCAASGFTFSSYAMSWVRQAPGKGLEWVSA<br>ISGSGGSTYYADSVKGRFTISRDNSKNTLYLQMNTLKAEDTAVYYCARAT<br>YKRELRYYYGMDVWGQGTTVTVSSGGGGSGGGGSGGGGSEIVLTQSPSTL<br>SLSPGESATLSCRASQSVSTTFLAWYQQKPGQAPRLLIYGSSNRATGIPD<br>RFSGSGSGTDFTLTIRRLEPEDFAVYYCQQYHSSPSWTFGQGTKVEIK |
| BCMA_EBB-<br>C1978-C7-nt<br>ScFv domain | 1124 | GAGGTGCAGCTTGTGGAAACCGGTGGCGGACTGGTGCAGCCCGGAGGAAG<br>CCTCAGGCTGTCCTGCGCCGCGTCCGGCTTCACCTTCTCCTCGTACGCCA<br>TGTCCTGGGTCCGCCAGGCCCCCGGAAAGGGCCTGGAATGGGTGTCCGCC<br>ATCTCTGGAAGCGGAGGTTCCACGTACTACGCGGACAGCGTCAAGGGAAG<br>GTTCACAATCTCCCGCGATAATTCGAAGAACACTCTGTACCTTCAAATGA<br>ACACCCTGAAGGCCGAGGACACTGCTGTGTACTACTGCGCACGGGCCACC<br>TACAAGAGAGAGCTCCGGTACTACTACGGAATGGACGTCTGGGGCCAGGG<br>AACTACTGTGACCGTGTCCTCGGAGGGGGTGGCTCCGGGGGGCGGCT<br>CCGGCGGAGGCGGTTCCGAGATTGTGCTGACCCAGTCACCTTCAACTCTG<br>TCGCTGTCCCCGGGAGAGAGCGCTACTCTGAGCTGCCGGGCCAGCCAGTC<br>CGTGTCCACCACCTTCCTCGCCTGGTATCAGCAGAAGCCGGGGCAGGCAC<br>CACGGCTCTTGATCTACGGGTCAAGCAACAGAGCGACCGGAATTCCTGAC<br>CGCTTCTCGGGGAGCGGTTCAGGCACCGACTTCACCCTGACTATCCGGCG<br>CCTGGAACCCGAAGATTTCGCCGTGTATTACTGTCAACAGTACCACTCCT<br>CGCCGTCCTGGACCTTTGGCCAAGGAACCAAAGTGGAAATCAAG |
| BCMA_EBB-<br>C1978-C7-<br>aa<br>VH | 1125 | EVQLVETGGGLVQPGGSLRLSCAASGFTFSSYAMSWVRQAPGKGLEWVSA<br>ISGSGGSTYYADSVKGRFTISRDNSKNTLYLQMNTLKAEDTAVYYCARAT<br>YKRELRYYYGMDVWGQGTTVTVSS |
| BCMA_EBB-<br>C1978-C7-<br>aa<br>VL | 1126 | EIVLTQSPSTLSLSPGESATLSCRASQSVSTTFLAWYQQKPGQAPRLLIY<br>GSSNRATGIPDRFSGSGSGTDFTLTIRRLEPEDFAVYYCQQYHSSPSWTF<br>GQGTKVEIK |
| BCMA_EBB-<br>C1978-C7-<br>aa<br>Full CART | 1127 | MALPVTALLLPLALLLHAARPEVQLVETGGGLVQPGGSLRLSCAASGFTF<br>SSYAMSWVRQAPGKGLEWVSAISGSGGSTYYADSVKGRFTISRDNSKNTL<br>YLQMNTLKAEDTAVYYCARATYKRELRYYYGMDVWGQGTTVTVSSGGGGS<br>GGGGSGGGGSEIVLTQSPSTLSLSPGESATLSCRASQSVSTTFLAWYQQK<br>PGQAPRLLIYGSSNRATGIPDRFSGSGSGTDFTLTIRRLEPEDFAVYYCQ<br>QYHSSPSWTFGQGTKVEIKTTTPAPRPPTPAPTIASQPLSLRPEACRPAA<br>GGAVHTRGLDFACDIYIWAPLAGTCGVLLLSLVITLYCKRGRKKLLYIFK<br>QPFMRPVQTTQEEDGCSCRFPEEEEGGCELRVKFSRSADAPAYKQGQNQL<br>YNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| BCMA_EBB-<br>C1978-C7-nt<br>Full CART | 1128 | ATGGCCCTCCCTGTCACCGCCCTGCTGCTTCCGCTGGCTCTTCTGCTCCA<br>CGCCGCTCGGCCCGAGGTGCAGCTTGTGGAAACCGGTGGCGGACTGGTGC<br>AGCCCGGAGGAAGCCTCAGGCTGTCCTGCGCCGCGTCCGGCTTCACCTTC<br>TCCTCGTACGCCATGTCCTGGGTCCGCCAGGCCCCCGGAAAGGGCCTGGA<br>ATGGGTGTCCGCCATCTCTGGAAGCGGAGGTTCCACGTACTACGCGGACA<br>GCGTCAAGGGAAGGTTCACAATCTCCCGCGATAATTCGAAGAACACTCTG<br>TACCTTCAAATGAACACCCTGAAGGCCGAGGACACTGCTGTGTACTACTG<br>CGCACGGGCCACCTACAAGAGAGAGCTCCGGTACTACTACGGAATGGACG |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | TCTGGGGCCAGGGAACTACTGTGACCGTGTCCTCGGGAGGGGGTGGCTCC<br>GGGGGGGGCGGCTCCGGCGGAGGCGGTTCCGAGATTGTGCTGACCCAGTC<br>ACCTTCAACTCTGTCGCTGTCCCCGGGAGAGAGCGCTACTCTGAGCTGCC<br>GGGCCAGCCAGTCCGTGTCCACCACCTTCCTCGCCTGGTATCAGCAGAAG<br>CCGGGGCAGGCACCACGGCTCTTGATCTACGGGTCAAGCAACAGAGCGAC<br>CGGAATTCCTGACCGCTTCTCGGGGAGCGGTTCAGGCACCGACTTCACCC<br>TGACTATCCGGCGCCTGGAACCCGAAGATTTCGCCGTGTATTACTGTCAA<br>CAGTACCACTCCTCGCCGTCCTGGACCTTTGGCCAAGGAACCAAAGTGGA<br>AATCAAGACCACTACCCCAGCACCGAGGCCACCCACCCCGGCTCCTACCA<br>TCGCCTCCCAGCCTCTGTCCCTGCGTCCGGAGGCATGTAGACCCGCAGCT<br>GGTGGGGCCGTGCATACCCGGGGTCTTGACTTCGCCTGCGATATCTACAT<br>TTGGGCCCCTCTGGCTGGTACTTGCGGGGTCCTGCTGCTTTCACTCGTGA<br>TCACTCTTTACTGTAAGCGCGGTCGGAAGAAGCTGCTGTACATCTTTAAG<br>CAACCCTTCATGAGGCCTGTGCAGACTACTAAGAGGAGGACGGCTGTTC<br>ATGCCGGTTCCCAGAGGAGGAGGAAGGCGGCTGCGAACTGCGCGTGAAAT<br>TCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAA<br>GCGGAGAGGACGGGACCCAGAAATGGGCGGGAAGCCGCGCAGAAAGAATC<br>CCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGA<br>CGGACTGTACCAGGGACTCAGCACCGCCACCAAGGACACCTATGACGCTC<br>TTCACATGCAGGCCCTGCCGCCTCGG |

BCMA_EBB-C1978-D10

| BCMA_EBB-<br>C1978-D10-<br>aa<br>ScFv domain | 1129 | EVQLVETGGGLVQPGRSLRLSCAASGFTFDDYAMHWVRQAPGKGLEWVSG<br>ISWNSGSIGYADSVKGRFTISRDNAKNSLYLQMNSLRDEDTAVYYCARVG<br>KAVPDVWGQGTTVTVSSGGGGSGGGGSGGGGSDIVMTQTPSSLSASVGDR<br>VTITCRASQSISSYLNWYQQKPGKAPKLLIYAASSLQSGVPSRFSGSGSG<br>TDFTLTISSLQPEDFATYYCQQSYSTPYSFGQGTRLEIK |
| BCMA_EBB-<br>C1978-D10-<br>nt<br>ScFv domain | 1130 | GAAGTGCAGCTCGTGGAAACTGGAGGTGGACTCGTGCAGCCTGGACGGTC<br>GCTGCGGCTGAGCTGCGCTGCATCCGGCTTCACCTTCGACGATTATGCCA<br>TGCACTGGGTCAGACAGGCGCCAGGGAAGGGACTTGAGTGGGTGTCCGGT<br>ATCAGCTGGAATAGCGGCTCAATCGGATACGCGGACTCCGTGAAGGGAAG<br>GTTCACCATTTCCCGCGACAACGCCAAGAACTCCCTGTACTTGCAAATGA<br>ACAGCCTCCGGGATGAGGACACTGCCGTGTACTACTGCGCCCGCGTCGGA<br>AAAGCTGTGCCCGACGTCTGGGGCCAGGGAACCACTGTGACCGTGTCCAG<br>CGGCGGGGGTGGATCGGGCGGTGGAGGGTCCGGTGGAGGGGGCTCAGATA<br>TTGTGATGACCCAGACCCCCTCGTCCCTGTCCGCCTCGGTCGGCGACCGC<br>GTGACTATCACATGTAGAGCCTCGCAGAGCATCTCCAGCTACCTGAACTG<br>GTATCAGCAGAAGCCGGGGAAGGCCCCGAAGCTCCTGATCTACGCGGCAT<br>CATCACTGCAATCGGGAGTGCCGAGCCGGTTTTCCGGGTCCGGCTCCGGC<br>ACCGACTTCACGCTGACCATTTCTTCCCTGCAACCCGAGGACTTCGCCAC<br>TTACTACTGCCAGCAGTCCTACTCCACCCCTTACTCCTTCGGCCAAGGAA<br>CCAGGCTGGAAATCAAG |
| BCMA_EBB-<br>C1978-D10-<br>aa<br>VH | 1131 | EVQLVETGGGLVQPGRSLRLSCAASGFTFDDYAMHWVRQAPGKGLEWVSG<br>ISWNSGSIGYADSVKGRFTISRDNAKNSLYLQMNSLRDEDTAVYYCARVG<br>KAVPDVWGQGTTVTVSS |
| BCMA_EBB-<br>C1978-D10-<br>aa<br>VL | 1132 | DIVMTQTPSSLSASVGDRVTITCRASQSISSYLNWYQQKPGKAPKLLIYA<br>ASSLQSGVPSRFSGSGSGTDFTLTISSLQPEDFATYYCQQSYSTPYSFGQ<br>GTRLEIK |
| BCMA_EBB-<br>C1978-D10-<br>aa<br>Full CART | 1133 | MALPVTALLLPLALLLHAARPEVQLVETGGGLVQPGRSLRLSCAASGFTF<br>DDYAMHWVRQAPGKGLEWVSGISWNSGSIGYADSVKGRFTISRDNAKNSL<br>YLQMNSLRDEDTAVYYCARVGKAVPDVWGQGTTVTVSSGGGGSGGGGSGG<br>GGSDIVMTQTPSSLSASVGDRVTITCRASQSISSYLNWYQQKPGKAPKLL<br>IYAASSLQSGVPSRFSGSGSGTDFTLTISSLQPEDFATYYCQQSYSTPYS<br>FGQGTRLEIKTTTPAPRPPTPAPTIASQPLSLRPEACRPAAGGAVHTRGL<br>DFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRR<br>EEYDVLDKRRGRDPEMGGKPRRKNPQEGLYNELQKDKMAEAYSEIGMKGE<br>RRRGKGHDGLYQGLSTATKDTYDALHMQALPPR |
| BCMA_EBB-<br>C1978-D10-<br>nt<br>Full CART | 1134 | ATGGCCCTCCCTGTCACCGCCCTGCTGCTTCCGCTGGCTCTTCTGCTCCA<br>CGCCGCTCGGCCCGAAGTGCAGCTCGTGGAAACTGGAGGTGGACTCGTGC<br>AGCCTGGACGGTCGCTGCGGCTGAGCTGCGCTGCATCCGGCTTCACCTTC<br>GACGATTATGCCATGCACTGGGTCAGACAGGCGCCAGGGAAGGGACTTGA<br>GTGGGTGTCCGGTATCAGCTGGAATAGCGGCTCAATCGGATACGCGGACT |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | CCGTGAAGGGAAGGTTCACCATTTCCCGCGACAACGCCAAGAACTCCCTG<br>TACTTGCAAATGAACAGCCTCCGGGATGAGGACACTGCCGTGTACTACTG<br>CGCCCGCGTCGGAAAAGCTGTGCCCGACGTCTGGGGCCAGGGAACCACTG<br>TGACCGTGTCCAGCGGCGGGGGTGGATCGGCGGTGGAGGGTCCGGTGGA<br>GGGGGCTCAGATATTGTGATGACCCAGACCCCCTCGTCCCTGTCCGCCTC<br>GGTCGGCGACCGCGTGACTATCACATGTAGAGCCTCGCAGAGCATCTCCA<br>GCTACCTGAACTGGTATCAGCAGAAGCCGGGGAAGGCCCCGAAGCTCCTG<br>ATCTACGCGGCATCATCACTGCAATCGGGAGTGCCGAGCCGGTTTTCCGG<br>GTCCGGCTCCGGCACCGACTTCACGCTGACCATTCTTCCCTGCAACCCG<br>AGGACTTCGCCACTTACTACTGCCAGCAGTCCTACTCCACCCCTTACTCC<br>TTCGGCCAAGGAACCAGGCTGGAAATCAAGACCACTACCCCAGCACCGAG<br>GCCACCCACCCCGGCTCCTACCATCGCCTCCCAGCCTCTGTCCCTGCGTC<br>CGGAGGCATGTAGACCCGCAGCTGGTGGGCCGTGCATACCCGGGGTCTT<br>GACTTCGCCTGCGATATCTACATTTGGGCCCCTCTGGCTGGTACTTGCGG<br>GGTCCTGCTGCTTTCACTCGTGATCACTCTTTACTGTAAGCGCGGTCGGA<br>AGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGG<br>CGGCTGCGAACTGCGCGTGAAATTCAGCCGCAGCGCAGATGCTCCAGCCT<br>ACAAGCAGGGGCAGAACCAGCTCTACAACGAACTCAATCTTGGTCGGAGA<br>GAGGAGTACGACGTGCTGGACAAGCGGAGAGGACGGGACCCAGAAATGGG<br>CGGGAAGCCGCGCAGAAAGAATCCCCAAGAGGGCCTGTACAACGAGCTCC<br>AAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGC<br>CACCAAGGACACCTATGACGCTCTTCACATGCAGGCCCTGCCGCCTCGG |
| | | BCMA_EBB-C1979-C12 |
| BCMA_EBB-<br>C1979-C12-<br>aa<br>ScFv domain | 1135 | EVQLVESGGGLVQPGRSLRLSCTASGFTFDDYAMHWVRQRPGKGLEWVAS<br>INWKGNSLAYGDSVKGRFAISRDNAKNTVFLQMNSLRTEDTAVYYCASHQ<br>GVAYYNYAMDVWGRGTLVTVSSGGGGSGGGGSGGGGSEIVLTQSPGTLSL<br>SPGERATLSCRATQSIGSSFLAWYQQRPGQAPRLLIYGASQRATGIPDRF<br>SGRGSGTDFTLTISRVEPEDSAVYYCQHYESSPSWTFGQGTKVEIK |
| BCMA_EBB-<br>C1979-C12-<br>nt<br>ScFv domain | 1136 | GAAGTGCAGCTCGTGGAGAGCGGGGGAGGATTGGTGCAGCCCGGAAGGTC<br>CCTGCGGCTCTCCTGCACTGCGTCTGGCTTCACCTTCGACGACTACGCGA<br>TGCACTGGGTCAGACAGCGCCCGGGAAAGGGCCTGGAATGGGTCGCCTCA<br>ATCAACTGGAAGGGAAACTCCCTGGCCTATGGCGACAGCGTGAAGGGCCG<br>CTTCGCCATTTCGCGCGACAACGCCAAGAACACCGTGTTTCTGCAAATGA<br>ATTCCCTGCGGACCGAGGATACCGCTGTGTACTACTGCGCCAGCCACCAG<br>GGCGTGGCATACTATAACTACGCCATGGACGTGTGGGGAAGAGGGACGCT<br>CGTCACCGTGTCCTCCGGGGGCGGTGGATCGGGTGGAGGAGGAAGCGGTG<br>GCGGGGGCAGCGAAATCGTGCTGACTCAGAGCCCGGGAACTCTTTCACTG<br>TCCCCGGGAGAACGGGCCACTCTCTCGTGCCGGGCCACCCAGTCCATCGG<br>CTCCTCCTTCCTTGCCTGGTACCAGCAGAGGCCAGGACAGGCGCCCCGCC<br>TGCTGATCTACGGTGCTTCCCAACGCGCCACTGGCATTCCTGACCGGTTC<br>AGCGGCAGAGGGTCGGGAACCGATTTCACACTGACCATTTCCCGGGTGGA<br>GCCCGAAGATTCGGCAGTCTACTACTGTCAGCATTACGAGTCCTCCCCTT<br>CATGGACCTTCGGTCAAGGGACCAAAGTGGAGATCAAG |
| BCMA_EBB-<br>C1979-C12-<br>aa<br>VH | 1137 | EVQLVESGGGLVQPGRSLRLSCTASGFTFDDYAMHWVRQRPGKGLEWVAS<br>INWKGNSLAYGDSVKGRFAISRDNAKNTVFLQMNSLRTEDTAVYYCASHQ<br>GVAYYNYAMDVWGRGTLVTVSS |
| BCMA_EBB-<br>C1979-C12-<br>aa<br>VL | 1138 | EIVLTQSPGTLSLSPGERATLSCRATQSIGSSFLAWYQQRPGQAPRLLIY<br>GASQRATGIPDRFSGRGSGTDFTLTISRVEPEDSAVYYCQHYESSPSWTF<br>GQGTKVEIK |
| BCMA_EBB-<br>C1979-C12-<br>aa<br>Full CART | 1139 | MALPVTALLLPLALLLHAARPEVQLVESGGGLVQPGRSLRLSCTASGFTF<br>DDYAMHWVRQRPGKGLEWVASINWKGNSLAYGDSVKGRFAISRDNAKNTV<br>FLQMNSLRTEDTAVYYCASHQGVAYYNYAMDVWGRGTLVTVSSGGGGSGG<br>GGSGGGGSEIVLTQSPGTLSLSPGERATLSCRATQSIGSSFLAWYQQRPG<br>QAPRLLIYGASQRATGIPDRFSGRGSGTDFTLTISRVEPEDSAVYYCQHY<br>ESSPSWTFGQGTKVEIKTTTPAPRPPTPAPTIASQPLSLRPEACRPAAGG<br>AVHTRGLDFACDIYIWAPLAGTCGVLLLSLVITLYCKRGRKKLLYIFKQP<br>FMRPVQTTQEEDGCSCRFPEEEEGGCELRVKFSRSADAPAYKQGQNQLYN<br>ELNLGRREEYDVLDKRRGRDPEMGGKPRRKNPQEGLYNELQKDKMAEAYS<br>EIGMKGERRRGKGHDGLYQGLSTATKDTYDALHMQALPPR |
| BCMA_EBB-<br>C1979-C12-<br>nt | 1140 | ATGGCCCTCCCTGTCACCGCCCTGCTGCTTCCGCTGGCTCTTCTGCTCCA<br>CGCCGCTCGGCCCGAAGTGCAGCTCGTGGAGAGCGGGGGAGGATTGGTGC<br>AGCCCGGAAGGTCCCTGCGGCTCTCCTGCACTGCGTCTGGCTTCACCTTC |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| Full CART | | GACGACTACGCGATGCACTGGGTCAGACAGCGCCCGGGAAAGGGCCTGGA<br>ATGGGTCGCCTCAATCAACTGGAAGGGAAACTCCCTGGCCTATGGCGACA<br>GCGTGAAGGGCCGCTTCGCCATTTCGCGCGACAACGCCAAGAACACCGTG<br>TTTCTGCAAATGAATTCCCTGCGGACCGAGGATACCGCTGTGTACTACTG<br>CGCCAGCCACCAGGGCGTGGCATACTATAACTACGCCATGGACGTGTGGG<br>GAAGAGGGACGCTCGTCACCGTGTCCTCCGGGGGCGGTGGATCGGGTGGA<br>GGAGGAAGCGGTGGCGGGGGCAGCGAAATCGTGCTGACTCAGAGCCCGGG<br>AACTCTTTCACTGTCCCCGGGAGAACGGGCCACTCTCTCGTGCCGGGCCA<br>CCCAGTCCATCGGCTCCTCCTTCCTTGCCTGGTACCAGCAGAGGCCAGGA<br>CAGGCGCCCCGCCTGCTGATCTACGGTGCTTCCCAACGCGCCACTGGCAT<br>TCCTGACCGGTTCAGCGGCAGAGGGTCGGGAACCGATTTCACACTGACCA<br>TTTCCCGGGTGGAGCCCGAAGATTCGGCAGTCTACTACTGTCAGCATTAC<br>GAGTCCTCCCCTTCATGGACCTTCGGTCAAGGGACCAAAGTGGAGATCAA<br>GACCACTACCCCAGCACCGAGGCCACCCACCCCGGCTCCTACCATCGCCT<br>CCCAGCCTCTGTCCCTGCGTCCGGAGGCATGTAGACCCGCAGCTGGTGGG<br>GCCGTGCATACCCGGGGTCTTGACTTCGCCTGCGATATCTACATTTGGGC<br>CCCTCTGGCTGGTACTTGCGGGGTCCTGCTGCTTTCACTCGTGATCACTC<br>TTTACTGTAAGCGCGGTCGGAAGAAGCTGCTGTACATCTTTAAGCAACCC<br>TTCATGAGGCCTGTGCAGACTACTCAAGAGGAGGACGGCTGTTCATGCCG<br>GTTCCCAGAGGAGGAGGAAGGCGGCTGCGAACTGCGCGTGAAATTCAGCC<br>GCAGCGCAGATGCTCCAGCCTACAAGCAGGGGCAGAACCAGCTCTACAAC<br>GAACTCAATCTTGGTCGGAGAGAGGAGTACGACGTGCTGGACAAGCGGAG<br>AGGACGGGACCCAGAAATGGGCGGGAAGCCGCGCAGAAAGAATCCCCAAG<br>AGGGCCTGTACAACGAGCTCCAAAAGGATAAGATGGCAGAAGCCTATAGC<br>GAGATTGGTATGAAAGGGGAACGCAGAAGAGGCAAAGGCCACGACGGACT<br>GTACCAGGGACTCAGCACCGCCACCAAGGACACCTATGACGCTCTTCACA<br>TGCAGGCCCTGCCGCCTCGG |

BCMA_EBB-C1980-G4

| BCMA_EBB-<br>C1980-G4-aa<br>ScFv domain | 1141 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVV<br>RDGMDVWGQGTTVTVSSGGGGSGGGGSGGGGSEIVLTQSPATLSLSPGER<br>ATLSCRASQSVSSSYLAWYQQKPGQAPRLLIYGASSRATGIPDRFSGNGS<br>GTDFTLTISRLEPEDFAVYYCQQYGSPPRFTFGPGTKVDIK |
| BCMA_EBB-<br>C1980-G4-nt<br>ScFv domain | 1142 | GAGGTGCAGTTGGTCGAAAGCGGGGGCGGGCTTGTGCAGCCTGGCGGATC<br>ACTGCGGCTGTCCTGCGCGGCATCAGGCTTCACGTTTTCTTCCTACGCCA<br>TGTCCTGGGTGCGCCAGGCCCCTGGAAAGGGACTGGAATGGGTGTCCGCA<br>ATTTCGGGGTCCGGCGGGAGCACCTACTACGCCGATTCCGTGAAGGGCCG<br>CTTCACTATCTCGCGGGACAACTCCAAGAACACCCTCTACCTCCAAATGA<br>ATAGCCTGCGGGCCGAGGATACCGCCGTCTACTATTGCGCTAAGGTCGTG<br>CGCGACGGAATGGACGTGTGGGGACAGGGTACCACCGTGACAGTGTCCTC<br>GGGGGGAGGCGGTAGCGGCGGAGGAGGAAGCGGTGGTGGAGGTTCCGAGA<br>TTGTGCTGACTCAATCACCCGCGACCCTGAGCCTGTCCCCCGGCGAAAGG<br>GCCACTCTGTCCTGTCGGGCCAGCCAATCAGTCTCCTCCTCGTACCTGGC<br>CTGGTACCAGCAGAAGCCAGGACAGGCTCCGAGACTCCTTATCTATGGCG<br>CATCCTCCCGCGCCACCGGAATCCCGGATAGGTTCTCGGGAAACGGATCG<br>GGGACCGACTTCACTCTCACCATCTCCCGGCTGGAACCGGAGGACTTCGC<br>CGTGTACTACTGCCAGCAGTACGGCAGCCCGCCTAGATTCACTTTCGGCC<br>CCGGCACCAAAGTGGACATCAAG |
| BCMA_EBB-<br>C1980-G4-aa<br>VH | 1143 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVV<br>RDGMDVWGQGTTVTVSS |
| BCMA_EBB-<br>C1980-G4-aa<br>VL | 1144 | EIVLTQSPATLSLSPGERATLSCRASQSVSSSYLAWYQQKPGQAPRLLIY<br>GASSRATGIPDRFSGNGSGTDFTLTISRLEPEDFAVYYCQQYGSPPRFTF<br>GPGTKVDIK |
| BCMA_EBB-<br>C1980-G4-aa<br>Full CART | 1145 | MALPVTALLLPLALLLHAARPEVQLVESGGGLVQPGGSLRLSCAASGFTF<br>SSYAMSWVRQAPGKGLEWVSAISGSGGSTYYADSVKGRFTISRDNSKNTL<br>YLQMNSLRAEDTAVYYCAKVVRDGMDVWGQGTTVTVSSGGGGSGGGGSGG<br>GGSEIVLTQSPATLSLSPGERATLSCRASQSVSSSYLAWYQQKPGQAPRL<br>LIYGASSRATGIPDRFSGNGSGTDFTLTISRLEPEDFAVYYCQQYGSPPR<br>FTFGPGTKVDIKTTTPAPRPPTPAPTIASQPLSLRPEACRPAAGGAVHTR<br>GLDFACDIYIWAPLAGTCGVLLLSLVITLYCKRGRKKLLYIFKQPFMRPV<br>QTTQEEDGCSCRFPEEEEGGCELRVKFSRSADAPAYKQGQNQLYNELNLG<br>RREEYDVLDKRRGRDPEMGGKPRRKNPQEGLYNELQKDKMAEAYSEIGMK<br>GERRRGKGHDGLYQGLSTATKDTYDALHMQALPPR |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| BCMA_EBB-<br>C1980-G4-nt<br>Full CART | 1146 | ATGGCCCTCCCTGTCACCGCCCTGCTGCTTCCGCTGGCTCTTCTGCTCCA<br>CGCCGCTCGGCCCGAGGTGCAGTTGGTCGAAAGCGGGGGCGGGCTTGTGC<br>AGCCTGGCGGATCACTGCGGCTGTCCTGCGCGGCATCAGGCTTCACGTTT<br>TCTTCCTACGCCATGTCCTGGGTGCGCCAGGCCCCTGGAAAGGGACTGGA<br>ATGGGTGTCCGCGATTTCGGGGTCCGGCGGGAGCACTACTACGCCGATT<br>CCGTGAAGGGCCGCTTCACTATCTCGCGGGACAACTCCAAGAACACCCTC<br>TACCTCCAAATGAATAGCCTGCGGGCCGAGGATACCGCCGTCTACTATTG<br>CGCTAAGGTCGTGCGCGACGGAATGGACGTGTGGGGACAGGGTACCACCG<br>TGACAGTGTCCTCGGGGGGAGGCGGTAGCGGCGGAGGAGGAAGCGGTGGT<br>GGAGGTTCCGAGATTGTGCTGACTCAATCACCCGCGACCCTGAGCCTGTC<br>CCCCGGCGAAAGGGCCACTCTGTCCTGTCGGGCCAGCCAATCAGTCTCCT<br>CCTCGTACCTGGCCTGGTACCAGCAGAAGCCAGGACAGGCTCCGAGACTC<br>CTTATCTATGGCGCATCCTCCCGCGCCACCGGAATCCCGGATAGGTTCTC<br>GGGAAACGGATCGGGGACCGACTTCACTCTCACCATCTCCCGGCTGGAAC<br>CGGAGGACTTCGCCGTGTACTACTGCCAGCAGTACGGCAGCCCGCCTAGA<br>TTCACTTTCGGCCCCGGCACCAAAGTGGACATCAAGACCACTACCCCAGC<br>ACCGAGGCCACCCACCCCGGCTCCTACCATCGCCTCCCAGCCTCTGTCCC<br>TGCGTCCGGAGGCATGTAGACCCGCAGCTGGTGGGGCCGTGCATACCCGG<br>GGTCTTGACTTCGCCTGCGATATCTACATTTGGGCCCCTCTGGCTGGTAC<br>TTGCGGGGTCCTGCTGCTTTCACTCGTGATCACTCTTTACTGTAAGCGCG<br>GTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGA<br>GGAAGGCGGCTGCGAACTGCGCGTGAAATTCAGCCGCAGCGCAGATGCTC<br>CAGCCTACAAGCAGGGGCAGAACCAGCTCTACAACGAACTCAATCTTGGT<br>CGGAGAGAGGAGTACGACGTGCTGGACAAGCGGAGAGGACGGGACCCAGA<br>AATGGGCGGGAAGCCGCGCAGAAAGAATCCCCAAGAGGGCCTGTACAACG<br>AGCTCCAAAAGGATAAGATGGCAGAAGCCTATAGCGAGATTGGTATGAAA<br>GGGGAACGCAGAAGAGGCAAAGGCCACGACGGACTGTACCAGGGACTCAG<br>CACCGCCACCAAGGACACCTATGACGCTCTTCACATGCAGGCCCTGCCGC<br>CTCGG |

BCMA_EBB-C1980-D2

| BCMA_EBB-<br>C1980-D2-aa<br>ScFv domain | 1147 | EVQLLESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKIP<br>QTGTFDYWGQGTLVTVSSGGGGSGGGGSGGGGSEIVLTQSPGTLSLSPGE<br>RATLSCRASQSVSSSYLAWYQQRPGQAPRLLIYGASSRATGIPDRFSGSG<br>SGTDFTLTISRLEPEDFAVYYCQHYGSSPSWTFGQGTRLEIK |
| BCMA_EBB-<br>C1980-D2-nt<br>ScFv domain | 1148 | GAAGTGCAGCTGCTGGAGTCCGGCGGTGGATTGGTGCAACCGGGGGGATC<br>GCTCAGACTGTCCTGTGCGGCGTCAGGCTTCACCTTCTCGAGCTACGCCA<br>TGTCATGGGTCAGACAGGCCCCTGGAAAGGGTCTGGAATGGGTGTCCGCC<br>ATTTCCGGGAGCGGGGGATCTACATACTACGCCGATAGCGTGAAGGGCCG<br>CTTCACCATTTCCCGGGACAACTCCAAGAACACTCTCTATCTGCAAATGA<br>ACTCCCTCCGCGCTGAGGACACTGCCGTGTACTACTGCGCCAAAATCCCT<br>CAGACCGGCACCTTCGACTACTGGGGACAGGGGACTCTGGTCACCGTCAG<br>CAGCGGTGGCGGAGGTTCGGGGGGAGGAGGAAGCGGCGGCGGAGGGTCCG<br>AGATTGTGCTGACCCAGTCACCCGGCACTTTGTCCCTGTCGCCTGGAGAA<br>AGGGCCACCCTTTCCTGCCGGGCATCCCAATCCGTGTCCTCCTCGTACCT<br>GGCCTGGTACCAGCAGAGGCCCGGACAGGCCCCACGGCTTCTGATCTACG<br>GAGCAAGCAGCCGCGACCGGTATCCCGGACCGGTTTTCGGGCTCGGGC<br>TCAGGAACTGACTTCACCCTCACCATCTCCCGCTGGAACCCGAAGATTT<br>CGCTGTGTATTACTGCCAGCACTACGGCAGCTCCCCGTCCTGGACGTTCG<br>GCCAGGGAACTCGGCTGGAGATCAAG |
| BCMA_EBB-<br>C1980-D2-aa<br>VH | 1149 | EVQLLESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKIP<br>QTGTFDYWGQGTLVTVSS |
| BCMA_EBB-<br>C1980-D2-aa<br>VL | 1150 | EIVLTQSPGTLSLSPGERATLSCRASQSVSSSYLAWYQQRPGQAPRLLTY<br>GASSRATGIPDRFSGSGSGTDFTLTISRLEPEDFAVYYCQHYGSSPSWTF<br>GQGTRLEIK |
| BCMA_EBB-<br>C1980-D2-aa<br>Full CART | 1151 | MALPVTALLLPLALLLHAARPEVQLLESGGGLVQPGGSLRLSCAASGFTF<br>SSYAMSWVRQAPGKGLEWVSAISGSGGSTYYADSVKGRFTISRDNSKNTL<br>YLQMNSLRAEDTAVYYCAKIPQTGTFDYWGQGTLVTVSSGGGGSGGGGSG<br>GGGSEIVLTQSPGTLSLSPGERATLSCRASQSVSSSYLAWYQQRPGQAPR<br>LLIYGASSRATGIPDRFSGSGSGTDFTLTISRLEPEDFAVYYCQHYGSSP<br>SWTFGQGTRLEIKTTTPAPRPPTPAPTIASQPLSRPEACRPAAGGAVHT<br>RGLDFACDIYIWAPLAGTCGVLLLSLVITLYCKRGRKKLLYIFKQPFMRP |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | VQTTQEEDGCSCRFPEEEEGGCELRVKFSRSADAPAYKQGQNQLYNELNL<br>GRREEYDVLDKRRGRDPEMGGKPRRKNPQEGLYNELQKDKMAEAYSEIGM<br>KGERRRGKGHDGLYQGLSTATKDTYDALHMQALPPR |
| BCMA_EBB-<br>C1980-D2-nt<br>Full CART | 1152 | ATGGCCCTCCCTGTCACCGCCCTGCTGCTTCCGCTGGCTCTTCTGCTCCA<br>CGCCGCTCGGCCCGAAGTGCAGCTGCTGGAGTCCGGCGGTGGATTGGTGC<br>AACCGGGGGGATCGCTCAGACTGTCCTGTGCGGCGTCAGGCTTCACCTTC<br>TCGAGCTACGCCATGTCATGGGTCAGACAGGCCCCTGGAAAGGGTCTGGA<br>ATGGGTGTCCGCCATTTCCGGGAGCGGGGGATCTACATACTACGCCGATA<br>GCGTGAAGGGCCGCTTCACCATTTCCCGGGACAACTCCAAGAACACTCTC<br>TATCTGCAAATGAACTCCCTCCGCGCTGAGGACACTGCCGTGTACTACTG<br>CGCCAAAATCCCTCAGACCGGCACCTTCGACTACTGGGGACAGGGGACTC<br>TGGTCACCGTCAGCAGCGGTGGCGGAGGTTCGGGGGGAGGAGGAAGCGGC<br>GGCGGAGGGTCCGAGATTGTGCTGACCCAGTCACCCGGCACTTTGTCCCT<br>GTCGCCTGGAGAAAAGGGCCACCCTTTCCTGCCGGGCATCCCAATCCGTGT<br>CCTCCTCGTACCTGGCCTGGTACCAGCAGAGGCCCGGACAGGCCCCACGG<br>CTTCTGATCTACGGAGCAAGCAGCCGCGCGACCGGTATCCCGGACCGGTT<br>TTCGGGCTCGGGCTCAGGAACTGACTTCACCCTCACCATCTCCCGCCTGG<br>AACCCGAAGATTTCGCTGTGTATTACTGCCAGCACTACGGCAGCTCCCCG<br>TCCTGGACGTTCGGCCAGGGAACTCGGCTGGAGATCAAGACCACTACCCC<br>AGCACCGAGGCCACCCACCCCGGCTCCTACCATCGCCTCCCAGCCTCTGT<br>CCCTGCGTCCGGAGGCATGTAGACCCGCAGCTGGTGGGGCCGTGCATACC<br>CGGGGTCTTGACTTCGCCTGCGATATCTACATTTGGGCCCCTCTGGCTGG<br>TACTTGCGGGGTCCTGCTGCTTTCACTCGTGATCACTCTTTACTGTAAGC<br>GCGGTCGGAAGAAGCTGCTGTACATCTTTAAGCAACCCTTCATGAGGCCT<br>GTGCAGACTACTCAAGAGGAGGACGGCTGTTCATGCCGGTTCCCAGAGGA<br>GGAGGAAGGCGGCTGCGAACTGCGCGTGAAATTCAGCCGCAGCGCAGATG<br>CTCCAGCCTACAAGCAGGGGCAGAACCAGCTCTACAACGAACTCAATCTT<br>GGTCGGAGAGAGGAGTACGACGTGCTGGACAAGCGGAGAGGACGGGACCC<br>AGAAATGGGCGGGAAGCCGCGCAGAAAGAATCCCCAAGAGGGCCTGTACA<br>ACGAGCTCCAAAAGGATAAGATGGCAGAAGCCTATAGCGAGATTGGTATG<br>AAAGGGGAACGCAGAAGAGGCAAAGGCCACGACGGACTGTACCAGGGACT<br>CAGCACCGCCACCAAGGACACCTATGACGCTCTTCACATGCAGGCCCTGC<br>CGCCTCGG |
| | | BCMA_EBB-C1978-A10 |
| BCMA_EBB-<br>C1978-A10-<br>aa<br>ScFv domain | 1153 | EVQLVETGGGLVQPGGSLRLSCAASGFTFSSYAMSWVRQAPGKGLEWVSA<br>ISGSGGSTYYADSVKGRFTMSRENDKNSVFLQMNSLRVEDTGVYYCARAN<br>YKRELRYYYGMDVWGQGTMVTVSSGGGGSGGGGSGGGGSEIVMTQSPGTL<br>SLSPGESATLSCRASQRVASNYLAWYQHKPGQAPSLLISGASSRATGVPD<br>RFSGSGSGTDFTLAISRLEPEDSAVYYCQHYDSSPSWTFGQGTKVEIK |
| BCMA_EBB-<br>C1978-A10-<br>nt<br>ScFv domain | 1154 | GAAGTGCAACTGGTGGAAACCGGTGGAGGACTCGTGCAGCCTGGCGGCAG<br>CCTCCGGCTGAGCTGCGCCGCTTCGGGATTCACCTTTTCCTCCTACGCGA<br>TGTCTTGGGTCAGACAGGCCCCCGGAAAGGGGCTGGAATGGGTGTCAGCC<br>ATCTCCGGCTCCGGCGGATCAACGTACTACGCCGACTCCGTGAAAGGCCG<br>GTTCACCATGTCGCGCGAGAATGACAAGAACTCCGTGTTCCTGCAAATGA<br>ACTCCCTGAGGGTGGAGGACACCGGAGTGTACTATTGTGCGCGCGCCAAC<br>TACAAGAGAGAGCTGCGGTACTACTACGGAATGGACGTCTGGGGACAGGG<br>AACTATGGTGACCGTGTCATCCGGTGGAGGGGGAAGCGGCGGTGGAGGCA<br>GCGGGGGCGGGGGTTCAGAAATTGTCATGACCCAGTCCCCGGGAACTCTT<br>TCCCTCTCCCCCGGGGAATCCGCGACTTTGTCCTGCCGGGCCAGCCAGCG<br>CGTGGCCTCGAACTACCTCGCATGGTACCAGCATAAGCCAGGCCAAGCCC<br>CTTCCCTGCTGATTTCCGGGGCTAGCAGCCGCGCCACTGGCGTGCCGGAT<br>AGGTTCTCGGGAAGCGGCTCGGGTACCGATTTCACCCTGGCAATCTCGCG<br>GCTGGAACCGGAGGATTCGGCCGTGTACTACTGCCAGCACTATGACTCAT<br>CCCCCTCCTGGACATTCGGACAGGGCACCAAGGTCGAGATCAAG |
| BCMA_EBB-<br>C1978-A10-<br>aa<br>VH | 1155 | EVQLVETGGGLVQPGGSLRLSCAASGFTFSSYAMSWVRQAPGKGLEWVSA<br>ISGSGGSTYYADSVKGRFTMSRENDKNSVFLQMNSLRVEDTGVYYCARAN<br>YKRELRYYYGMDVWGQGTMVTVSS |
| BCMA_EBB-<br>C1978-A10-<br>aa<br>VL | 1156 | EIVMTQSPGTLSLSPGESATLSCRASQRVASNYLAWYQHKPGQAPSLLIS<br>GASSRATGVPDRFSGSGSGTDFTLAISRLEPEDSAVYYCQHYDSSPSWTF<br>GQGTKVEIK |
| BCMA_EBB-<br>C1978-A10-<br>aa<br>Full CART | 1157 | MALPVTALLLPLALLLHAARPEVQLVETGGGLVQPGGSLRLSCAASGFTF<br>SSYAMSWVRQAPGKGLEWVSAISGSGGSTYYADSVKGRFTMSRENDKNSV<br>FLQMNSLRVEDTGVYYCARANYKRELRYYYGMDVWGQGTMVTVSSGGGGS<br>GGGGSGGGGSEIVMTQSPGTLSLSPGESATLSCRASQRVASNYLAWYQHK |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| | | PGQAPSLLISGASSRATGVPDRFSGSGSGTDFTLAISRLEPEDSAVYYCQ<br>HYDSSPSWTFGQGTKVEIKTTTPAPRPPTPAPTIASQPLSLRPEACRPAA<br>GGAVHTRGLDFACDIYIWAPLAGTCGVLLLSLVITLYCKRGRKKLLYIFK<br>QPFMRPVQTTQEEDGCSCRFPEEEEGGCELRVKFSRSADAPAYKQGQNQL<br>YNELNLGRREEYDVLDKRRGRDPEMGGKPRRKNPQEGLYNELQKDKMAEA<br>YSEIGMKGERRRGKGHDGLYQGLSTATKDTYDALHMQALPPR |
| BCMA_EBB-<br>C1978-A10-<br>nt<br>Full CART | 1158 | ATGGCCCTCCCTGTCACCGCCCTGCTGCTTCCGCTGGCTCTTCTGCTCCA<br>CGCCGCTCGGCCCGAAGTGCAACTGGTGGAAACCGGTGGAGGACTCGTGC<br>AGCCTGGCGGCAGCCTCCGGCTGAGCTGCGCCGCTTCGGGATTCACCTTT<br>TCCTCCTACGCGATGTCTTGGGTCAGACAGGCCCCCGGAAAGGGGCTGGA<br>ATGGGTGTCAGCCATCTCCGGCTCCGGCGGATCAACGTACTACGCCGACT<br>CCGTGAAAGGCCGGTTCACCATGTCGCGCGAGAATGACAAGAACTCCGTG<br>TTCCTGCAAATGAACTCCCTGAGGGTGGAGGACACCGGAGTGTACTATTG<br>TGCGCGCGCCAACTACAAGAGAGAGCTGCGGTACTACTACGGAATGGACG<br>TCTGGGGACAGGGAACTATGGTGACCGTGTCATCCGGTGGAGGGGGAAGC<br>GGCGGTGGAGGCAGCGGGGGCGGGGGTTCAGAAATTGTCATGACCCAGTC<br>CCCGGGAACTCTTTCCCTCTCCCCCGGGGAATCCGCGACTTTGTCCTGCC<br>GGGCCAGCCAGCGCGTGGCCTCGAACTACCTCGCATGGTACCAGCATAAG<br>CCAGGCCAAGCCCCTTCCCTGCTGATTTCCGGGGCTAGCAGCCGCGCCAC<br>TGGCGTGCCGGATAGGTTCTCGGGAAGCGGCTCGGGTACCGATTTCACCC<br>TGGCAATCTCGCGGCTGGAACCGGAGGATTCGGCCGTGTACTACTGCCAG<br>CACTATGACTCATCCCCCTCCTGGACATTCGGACAGGGCACCAAGGTCGA<br>GATCAAGACCACTACCCCAGCACCGAGGCCACCCACCCCGGCTCCTACCA<br>TCGCCTCCCAGCCTCTGTCCCTGCGTCCGGAGGCATGTAGACCCGCAGCT<br>GGTGGGGCCGTGCATACCCGGGGTCTTGACTTCGCCTGCGATATCTACAT<br>TTGGGCCCCTCTGGCTGGTACTTGCGGGGTCCTGCTGCTTTCACTCGTGA<br>TCACTCTTTACTGTAAGCGCGGTCGGAAGAAGCTGCTGTACATCTTTAAG<br>CAACCCTTCATGAGGCCTGTGCAGACTACTCAAGAGGAGGACGGCTGTTC<br>ATGCCGGTTCCCAGAGGAGGAGGAAGGCGGCTGCGAACTGCGCGTGAAAT<br>TCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAA<br>GCGGAGAGGACGGGACCCAGAAATGGGCGGGAAGCCGCGCAGAAAGAATC<br>CCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGA<br>CGGACTGTACCAGGGACTCAGCACCGCCACCAAGGACACCTATGACGCTC<br>TTCACATGCAGGCCCTGCCGCCTCGG |

BCMA_EBB-C1978-D4

| BCMA_EBB-<br>C1978-D4-aa<br>ScFv domain | 1159 | EVQLLETGGGLVQPGGSLRLSCAASGFSFSSYAMSWVRQAPGKGLEWVSA<br>ISGSGGSTYYADSVKGRFTISRDNSKNTLYLQMNSLRAEDTAVYYCAKAL<br>VGATGAFDIWGQGTLVTVSSGGGGSGGGGSGGGGSEIVLTQSPGTLSLSP<br>GERATLSCRASQSLSSNFLAWYQQKPGQAPGLLIYGASNWATGTPDRFSG<br>SGSGTDFTLTITRLEPEDFAVYYCQYYGTSPMYTFGQGTKVEIK |
| BCMA_EBB-<br>C1978-D4-nt<br>ScFv domain | 1160 | GAAGTGCAGCTGCTCGAAACCGGTGGAGGGCTGGTGCAGCCAGGGGGCTC<br>CCTGAGGCTTTCATGCGCCGCTAGCGGATTCTCCTTCTCCTCTTACGCCA<br>TGTCGTGGGTCCGCCAAGCCCCTGGAAAAGGCCTGGAATGGGTGTCCGCG<br>ATTTCCGGGAGCGGAGGTTCGACCTATTACGCCGACTCCGTGAAGGGCCG<br>CTTTACCATCTCCCGGGATAACTCCAAGAACACTCTGTACCTCCAAATGA<br>ACTCGCTGAGAGCCGAGGACACCGCCGTGTATTACTGCGCGAAGGCGCTG<br>GTCGGCGCGACTGGGGCATTCGACATCTGGGGACAGGGAACTCTTGTGAC<br>CGTGTCGAGCGGAGGCGGCGGCTCCGGCGGAGGAGGGAGCGGGGGCGGTG<br>GTTCCGAAATCGTGTTGACTCAGTCCCCGGGAACCCTGAGCTTGTCACCC<br>GGGGAGCGGGCCACTCTCTCCTGTCGCGCCTCCCAATCGCTCTCATCCAA<br>TTTCCTGGCCTGGTACCAGCAGAAGCCCGGACAGGCCCCGGGCCTGCTCA<br>TCTACGGCGCTTCAAACTGGGCAACGGGAACCCCTGATCGGTTCAGCGGA<br>AGCGGATCGGGTACTGACTTTACCCTGACCATCACCAGACTGGAACCGGA<br>GGACTTCGCCGTGTACTACTGCCAGTACTACGGCACCTCCCCCATGTACA<br>CATTCGGACAGGGTACCAAGGTCGAGATTAAG |
| BCMA_EBB-<br>C1978-D4-aa<br>VH | 1161 | EVQLLETGGGLVQPGGSLRLSCAASGFSFSSYAMSWVRQAPGKGLEWVSA<br>ISGSGGSTYYADSVKGRFTISRDNSKNTLYLQMNSLRAEDTAVYYCAKAL<br>VGATGAFDIWGQGTLVTVSS |
| BCMA_EBB-<br>C1978-D4-aa<br>VL | 1162 | EIVLTQSPGTLSLSPGERATLSCRASQSLSSNFLAWYQQKPGQAPGLLIY<br>GASNWATGTPDRFSGSGSGTDFTLTITRLEPEDFAVYYCQYYGTSPMYTF<br>GQGTKVEIK |
| BCMA_EBB-<br>C1978-D4-aa<br>Full CART | 1163 | MALPVTALLLPLALLLHAARPEVQLLETGGGLVQPGGSLRLSCAASGFSF<br>SSYAMSWVRQAPGKGLEWVSAISGSGGSTYYADSVKGRFTISRDNSKNTL<br>YLQMNSLRAEDTAVYYCAKALVGATGAFDIWGQGTLVTVSSGGGGSGGGG |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| | | SGGGGSEIVLTQSPGTLSLPGERATLSCRASQSLSSNFLAWYQQKPGQA PGLLIYGASNWATGTPDRFSGSGSGTDFTLTITRLEPEDFAVYYCQYYGT SPMYTFGQGTKVEIKTTTPAPRPPTPAPTIASQPLSLRPEACRPAAGGAV HTRGLDFACDIYIWAPLAGTCGVLLLSLVITLYCKRGRKKLLYIFKQPFM RPVQTTQEEDGCSCRFPEEEEGGCELRVKFSRSADAPAYKQGQNQLYNEL NLGRREEYDVLDKRRGRDPEMGGKPRRKNPQEGLYNELQKDKMAEAYSEI GMKGERRRGKGHDGLYQGLSTATKDTYDALHMQALPPR |
| BCMA_EBB-C1978-D4-nt Full CART | 1164 | ATGGCCCTCCCTGTCACCGCCCTGCTGCTTCCGCTGGCTCTTCTGCTCCA CGCCGCTCGGCCCGAAGTGCAGCTGCTCGAAACCGGTGGAGGGCTGGTGC AGCCAGGGGGCTCCCTGAGGCTTTCATGCGCCGCTAGCGGATTCTCCTTC TCCTCTTACGCCATGTCGTGGGTCCGCCAAGCCCCTGGAAAAGGCCTGGA ATGGGTGTCCGCGATTTCCGGAGCGGAGGTTCGACCTATTACGCCGACT CCGTGAAGGGCCGCTTTACCATCTCCCGGGATAACTCCAAGAACACTCTG TACCTCCAAATGAACTCGCTGAGAGCCGAGGACACCGCCGTGTATTACTG CGCGAAGGCGCTGGTCGGCGCGACTGGGGCATTCGACATCTGGGGACAGG GAACTCTTGTGACCGTGTCGAGCGGAGGCGGCGGCTCCGGCGGAGGAGGG AGCGGGGGCGGTGGTTCCGAAATCGTTGTTGACTCAGTCCCCGGGAACCCT GAGCTTGTCACCCGGGGAGCGGGCCACTCTCTCCTGTCGCGCCTCCCAAT CGCTCTCATCCAATTTCCTGGCCTGGTACCAGCAGAAGCCCGGACAGGCC CCGGGCCTGCTCATCTACGGCGCTTCAAACTGGGCAACGGGAACCCCTGA TCGGTTCAGCGGAAGCGGATCGGGTACTGACTTTACCCTGACCATCACCA GACTGGAACCGGAGGACTTCGCCGTGTACTACTGCCAGTACTACGGCACC TCCCCCATGTACACATTCGGACAGGGTACCAAGGTCGAGATTAAGACCAC TACCCCAGCACCGAGGCCACCCACCCCGGCTCCTACCATCGCCTCCCAGC CTCTGTCCCTGCGCTCCGGAGGCATGTAGACCCGCAGCTGGTGGGCCGTG CATACCCGGGGTCTTGACTTCGCCTGCGATATCTACATTTGGGCCCCTCT GGCTGGTACTTGCGGGGTCCTGCTGCTTTCACTCGTGATCACTCTTTACT GTAAGCGCGGTCGGAAGAAGCTGCTGTACATCTTTAAGCAACCCTTCATG AGGCCTGTGCAGACTACTCAAGAGGAGGACGGCTGTTCATGCCGGTTCCC AGAGGAGGAGGAAGGCGGCTGCGAACTGCGCGTGAAATTCAGCCGCAGCG CAGATGCTCCAGCCTACAAGCAGGGGCAGAACCAGCTCTACAACGAACTC AATCTTGGTCGGAGAGAGGAGTACGACGTGCTGGACAAGCGGAGAGGACG GGACCCAGAAATGGGCGGGAAGCCGCGCAGAAAGAATCCCCAAGAGGGCC TGTACAACGAGCTCCAAAAGGATAAGATGGCAGAAGCCTATAGCGAGATT GGTATGAAAGGGGAACGCAGAAGAGGCAAAGGCCACGACGGACTGTACCA GGGACTCAGCACCGCCACCAAGGACACCTATGACGCTCTTCACATGCAGG CCCTGCCGCCTCGG |

BCMA_EBB-C1980-A2

| BCMA_EBB-C1980-A2-aa ScFv domain | 1165 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCVLWF GEGFDPWGQGTLVTVSSGGGGSGGGGSGGGGSDIVLTQSPLSLPVTPGEP ASISCRSSQSLLHSNGYNYLDWYLQKPGQSPQLLIYLGSNRASGVPDRFS GSGSGTDFTLKISRVEAEDVGVYYCMQALQTPLTFGGGTKVDIK |
| BCMA_EBB-C1980-A2-nt ScFv domain | 1166 | GAAGTGCAGCTGCTTGAGAGCGGTGGAGGTCTGGTGCAGCCCGGGGGATC ACTGCGCCTGTCCTGTGCCGCGTCCGGTTTCACTTTCTCCTCGTACGCCA TGTCGTGGGTCAGACAGGCACCGGGAAAGGGACTGGAATGGGTGTCAGCC ATTTCGGGTTCGGGGGGCAGCACCTACTACGCTGACTCCGTGAAGGGCCG GTTCACCATTTCCCGCGACAACTCCAAGAACACCTTGTACCTCCAAATGA ACTCCCTGCGGGCCGAAGATACCGCCGTGTATTACTGCGTGCTGTGGTTC GGAGAGGGATTCGACCCGTGGGGACAAGGAACACTCGTGACTGTGTCATC CGGCGGAGGCGGCAGCGGTGGCGGCGGTTCCGGCGGCGGCGGATCTGACA TCGTGTTGACCCAGTCCCCTCTGAGCCTGCCGGTCACTCCTGGCGAACCA GCCAGCATCTCCTGCCGGTCGAGCCAGTCCCTCCTGCACTCCAATGGGTA CAACTACCTCGATTGGTATCTGCAAAAGCCGGGCCAGAGCCCCCAGCTGC TGATCTACCTTGGGTCAAACCGCGCTTCCGGGGTGCCTGATAGATTCTCC GGGTCCGGGAGCGGAACCGACTTTACCCTGAAAATCTCGAGGGTGGAGGC CGAGGACGTCGGAGTGTACTACTGCATGCAGGCGCTCCAGACTCCCCTGA CCTTCGGAGGAGGAACGAAGGTCGACATCAAGA |
| BCMA_EBB-C1980-A2-aa VH | 1167 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCVLWF GEGFDPWGQGTLVTVSS |
| BCMA_EBB-C1980-A2-aa VL | 1168 | DIVLTQSPLSLPVTPGEPASISCRSSQSLLHSNGYNYLDWYLQKPGQSPQ LLIYLGSNRASGVPDRFSGSGSGTDFTLKISRVEAEDVGVYYCMQALQTP LTFGGGTKVDIK |
| BCMA_EBB-C1980-A2-aa | 1169 | MALPVTALLLPLALLLHAARPEVQLLESGGGLVQPGGSLRLSCAASGFTF SSYAMSWVRQAPGKGLEWVSAISGSGGSTYYADSVKGRFTISRDNSKNTL |

TABLE 5-continued

Amino Acid and Nucleic Acid Sequences of exemplary
anti-BCMA scFv domains and BCMA CAR molecules

| Name/<br>Description | SEQ<br>ID<br>NO: | Sequence |
|---|---|---|
| Full CART | | YLQMNSLRAEDTAVYYCVLWFGEGFDPWGQGTLVTVSSGGGGSGGGGSGG<br>GGSDIVLTQSPLSLPVTPGEPASISCRSSQSLLHSNGYNYLDWYLQKPGQ<br>SPQLLIYLGSNRASGVPDRFSGSGSGTDFTLKISRVEAEDVGVYYCMQAL<br>QTPLTFGGGTKVDIKTTTPAPRPPTPAPTIASQPLSLRPEACRPAAGGAV<br>HTRGLDFACDIYIWAPLAGTCGVLLLSLVITLYCKRGRKKLLYIFKQPFM<br>RPVQTTQEEDGCSCRFPEEEEGGCELRVKFSRSADAPAYKQGQNQLYNEL<br>NLGRREEYDVLDKRRGRDPEMGGKPRRKNPQEGLYNELQKDKMAEAYSEI<br>GMKGERRRGKGHDGLYQGLSTATKDTYDALHMQALPPR |
| BCMA_EBB-<br>C1980-A2-nt<br>Full CART | 1170 | ATGGCCCTCCCTGTCACCGCCCTGCTGCTTCCGCTGGCTCTTCTGCTCCA<br>CGCCGCTCGGCCCGAAGTGCAGCTGCTTGAGAGCGGTGGAGGTCTGGTGC<br>AGCCCGGGGGATCACTGCGCCTGTCCTGTGCCGCGTCCGGTTTCACTTTC<br>TCCTCGTACGCCATGTCGTGGGTCAGACAGGCACCGGGAAAGGGACTGGA<br>ATGGGTGTCAGCCATTTCGGGTTCGGGGGGCAGCACCTACTACGCTGACT<br>CCGTGAAGGGCCGGTTCACCATTTCCCGCGACAACTCCAAGAACACCTTG<br>TACCTCCAAATGAACTCCCTGCGGGCCGAAGATACCGCCGTGTATTACTG<br>CGTGCTGTGGTTCGGAGAGGGATTCGACCCGTGGGGACAAGGAACACTCG<br>TGACTGTGTCATCCGGCGGAGGCGGCAGCGGTGGCGGCGGTTCCGGCGGC<br>GGCGGATCTGACATCGTGTTGACCCAGTCCCCTCTGAGCCTGCCGGTCAC<br>TCCTGGCGAACCAGCCAGCATCTCCTGCCGGTCGAGCCAGTCCCTCCTGC<br>ACTCCAATGGGTACAACTACCTCGATTGGTATCTGCAAAAGCCGGGCCAG<br>AGCCCCCAGCTGCTGATCTACCTTGGGTCAAACCGCGCTTCCGGGGTGCC<br>TGATAGATTCTCCGGGTCCGGGAGCGGAACCGACTTTACCCTGAAAATCT<br>CGAGGGTGGAGGCCGAGGACGTCGGAGTGTACTACTGCATGCAGGCGCTC<br>CAGACTCCCCTGACCTTCGGAGGAGGAACGAAGGTCGACATCAAGACCAC<br>TACCCCAGCACCGAGGCCACCCACCCCGGCTCCTACCATCGCCTCCCAGC<br>CTCTGTCCCTGCGTCCGGAGGCATGTAGACCCGCAGCTGGTGGGGCCGTG<br>CATACCCGGGGTCTTGACTTCGCCTGCGATATCTACATTTGGGCCCCTCT<br>GGCTGGTACTTGCGGGGTCCTGCTGCTTTCACTCGTGATCACTCTTTACT<br>GTAAGCGCGGTCGGAAGAAGCTGCTGTACATCTTTAAGCAACCCTTCATG<br>AGGCCTGTGCAGACTACTCAAGAGGAGGACGGCTGTTCATGCCGGTTCCC<br>AGAGGAGGAGGAAGGCGGCTGCGAACTGCGCGTGAAATTCAGCCGCAGCG<br>CAGATGCTCCAGCCTACAAGCAGGGGCAGAACCAGCTCTACAACGAACTC<br>AATCTTGGTCGGAGAGAGGAGTACGACGTGCTGGACAAGCGGAGAGGACG<br>GGACCCAGAAATGGGCGGGAAGCCGCGCAGAAAGAATCCCCAAGAGGGCC<br>TGTACAACGAGCTCCAAAAGGATAAGATGGCAGAAGCCTATAGCGAGATT<br>GGTATGAAAGGGGAACGCAGAAGAGGCAAAGGCCACGACGGACTGTACCA<br>GGGACTCAGCACCGCCACCAAGGACACCTATGACGCTCTTCACATGCAGG<br>CCCTGCCGCCTCGG |

BCMA_EBB-C1981-C3

| BCMA_EBB-<br>C1981-C3-aa<br>ScFv domain | 1171 | QVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVG<br>YDSSGYYRDYYGMDVWGQGTTVTVSSGGGGSGGGGSGGGGSEIVLTQSPG<br>TLSLSPGERATLSCRASQSVSSSYLAWYQQKPGQAPRLLIYGTSSRATGI<br>SDRFSGSGSGTDFTLTISRLEPEDFAVYYCQHYGNSPPKFTFGPGTKLEI<br>K |
| BCMA_EBB-<br>C1981-C3-nt<br>ScFv domain | 1172 | CAAGTGCAGCTCGTGGAGTCAGGCGGAGGACTGGTGCAGCCCGGGGGCTC<br>CCTGAGACTTTCTGCGCGGCATCGGGTTTTACCTTCTCCTCCTATGCTA<br>TGTCCTGGGTGCGCCAGGCCCCGGGAAAGGGACTGGAATGGGTGTCCGCA<br>ATCAGCGGTAGCGGGGGCTCAACATACTACGCCGACTCCGTCAAGGGTCG<br>CTTCACTATTTCCCGGGACAACTCCAAGAATACCCTGTACCTCCAAATGA<br>ACAGCCTCAGGGCCGAGGATACTGCCGTGTACTACTGCGCCAAAGTCGGA<br>TACGATAGCTCCGGTTACTACCGGGACTACTACGGAATGGACGTGTGGGG<br>ACAGGGCACCACCGTGACCGTGTCAAGCGGCGGAGGCGGTTCAGGAGGGG<br>GAGGCTCCGGCGGTGGAGGGTCCGAAATCGTCCTGACTCAGTCGCCTGGC<br>ACTCTGTCGTTGTCCCCGGGGAGCGCGCTACCCTGTCGTGTCGGGCGTC<br>GCAGTCCGTGTCGAGCTCCTACCTCGCGTGGTACCAGCAGAAGCCCGGAC<br>AGGCCCCTAGACTTCTGATCTACGGCACTTCTTCACGCGCCACCGGGATC<br>AGCGACAGGTTCAGCGGCTCCGGCTCCGGGACCGACTTCACCCTGACCAT<br>TAGCCGGCTGGAGCCTGAAGATTTCGCCGTGTATTACTGCCAACACTACG<br>GAAACTCGCCGCCAAAGTTCACGTTCGGACCCGGAACCAAGCTGGAAATC<br>AAG |
| BCMA_EBB-<br>C1981-C3-aa<br>VH | 1173 | QVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVG<br>YDSSGYYRDYYGMDVWGQGTTVTVSS |
| BCMA_EBB-<br>C1981-C3-aa<br>VL | 1174 | EIVLTQSPGTLSLSPGERATLSCRASQSVSSSYLAWYQQKPGQAPRLLIY<br>GTSSRATGISDRFSGSGSGTDFTLTISRLEPEDFAVYYCQHYGNSPPKFT<br>FGPGTKLEIK |

TABLE 5-continued

Amino Acid and Nucleic Acid Sequences of exemplary
anti-BCMA scFv domains and BCMA CAR molecules

| Name/ Description | SEQ ID NO: | Sequence |
|---|---|---|
| BCMA_EBB-C1981-C3-aa Full CART | 1175 | MALPVTALLLPLALLLHAARPQVQLVESGGGLVQPGGSLRLSCAASGFTF SSYAMSWVRQAPGKGLEWVSAISGSGGSTYYADSVKGRFTISRDNSKNTL YLQMNSLRAEDTAVYYCAKVGYDSSGYYRDYYGMDVWGQGTTVTVSSGGG GSGGGGSGGGGSEIVLTQSPGTLSLSPGERATLSCRASQSVSSSYLAWYQ QKPGQAPRLLIYGTSSRATGISDRFSGSGSGTDFTLTISRLEPEDFAVYY CQHYGNSPPKFTFGPGTKLEIKTTTPAPRPPTPAPTIASQPLSRPEACR PAAGGAVHTRGLDFACDIYIWAPLAGTCGVLLLSLVITLYCKRGRKKLLY IFKQPFMRPVQTTQEEDGCSCRFPEEEEGGCELRVKFSRSADAPAYKQGQ NQLYNELNLGRREEYDVLDKRRGRDPEMGGKPRRKNPQEGLYNELQKDKM AEAYSEIGMKGERRRGKGHDGLYQGLSTATKDTYDALHMQALPPR |
| BCMA_EBB-C1981-C3-nt Full CART | 1176 | ATGGCCCTCCCTGTCACCGCCCTGCTGCTTCCGCTGGCTCTTCTGCTCCA CGCCGCTCGGCCCCAAGTGCAGCTCGTGGAGTCAGGCGGAGGACTGGTGC AGCCCGGGGGCTCCCTGAGACTTTCCTGCGCGGCATCGGGTTTTACCTTC TCCTCCTATGCTATGTCCTGGGTGCGCCAGGCCCCGGGAAAGGGACTGGA ATGGGTGTCCGCAATCAGCGGTAGCGGGGGCTCAACATACTACGCCGACT CCGTCAAGGGTCGCTTCACTATTTCCCGGGACAACTCCAAGAATACCCTG TACCTCCAAATGAACAGCCTCAGGGCCGAGGATACTGCCGTGTACTACTG CGCCAAAGTCGGATACGATAGCTCCGGTTACTACCGGGACTACTACGGAA TGGACGTGTGGGGACAGGGCACCACCGTGACCGTGTCAAGCGGCGGAGGC GGTTCAGGAGGGGGAGGCTCCGGCGGTGGAGGGTCCGAAATCGTCCTGAC TCAGTCGCCTGGCACTCTGTCGTTGTCCCCGGGGGAGCGCGCTACCCTGT CGTGTCGGGCGTCGCAGTCCGTGTCGAGCTCCTACCTCGCGTGGTACCAG CAGAAGCCCGGACAGGCCCCTAGACTTCTGATCTACGGCACTTCTTCACG CGCCACCGGGATCAGCGACAGGTTCAGCGGCTCCGGCTCCGGGACCGACT TCACCCTGACCATTAGCCGGCTGGAGCCTGAAGATTTCGCCGTGTATTAC TGCCAACACTACGGAAACTCGCCGCCAAAGTTCACGTTCGGACCCGGAAC CAAGCTGGAAATCAAGACCACTACCCCAGCACCGAGGCCACCCACCCCGG CTCCTACCATCGCCTCCCAGCCTCTGTCCCTGCGTCCGGAGGCATGTAGA CCCGCAGCTGGTGGGGCCGTGCATACCCGGGGTCTTGACTTCGCCTGCGA TATCTACATTTGGGCCCCTCTGGCTGGTACTTGCGGGGTCCTGCTGCTTT CACTCGTGATCACTCTTTACTGTAAGCGCGGTCGGAAGAAGCTGCTGTAC ATCTTTAAGCAACCCTTCATGAGGCCTGTGCAGACTACTCAAGAGGAGGA CGGCTGTTCATGCCGGTTCCCAGAGGAGGAGGAAGGCGGCTGCGAACTGC GCGTGAAATTCAGCCGCAGCGCAGATGCTCCAGCCTACAAGCAGGGGCAG AACCAGCTCTACAACGAACTCAATCTTGGTCGGAGAGAGGAGTACGACGT GCTGGACAAGCGGAGAGGACGGGACCCAGAAATGGGCGGGAAGCCGCGCA GAAAGAATCCCCAAGAGGGCCTGTACAACGAGCTCCAAAAGGATAAGATG GCAGAAGCCTATAGCGAGATTGGTATGAAAGGGGAACGCAGAAGAGGCAA AGGCCACGACGGACTGTACCAGGGACTCAGCACCGCCACCAAGGACACCT ATGACGCTCTTCACATGCAGGCCCTGCCGCCTCGG |

BCMA_EBB-C1978-G4

| Name/ Description | SEQ ID NO: | Sequence |
|---|---|---|
| BCMA_EBB-C1978-G4-aa ScFv domain | 1177 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKMG WSSGYLGAFDIWGQGTTVTVSSGGGGSGGGGSGGGGSEIVLTQSPGTLSL SPGERATLSCRASQSVASSFLAWYQQKPGQAPRLLIYGASGRATGIPDRF SGSGSGTDFTLTISRLEPEDFAVYYCQHYGGSPRLTFGGGTKVDIK |
| BCMA_EBB-C1978-G4-nt ScFv domain | 1178 | GAAGTCCAACTGGTGGAGTCCGGGGGAGGGCTCGTGCAGCCCGGAGGCAG CCTTCGGCTGTCGTGCGCCGCCTCCGGGTTCACGTTCTCATCCTACGCGA TGTCGTGGGTCAGACAGGCCACCAGGAAAGGGACTGGAATGGGTTCCGCC ATTAGCGGCTCCGGCGGTAGCACCTACTATGCCGACTCAGTGAAGGGAAG GTTCACTATCTCCCGCGACAACAGCAAGAACACCCTGTACCTCCAAATGA ACTCTCTGCGGGCCGAGGATACCGCGGTGTACTATTGCGCCAAGATGGGT TGGTCCAGCGGATACTTGGGAGCCTTCGACATTTGGGGACAGGGCACTAC TGTGACCGTGTCCTCCGGGGGTGGCGGATCGGAGGCGGCGGCTCGGGTG GAGGGGGTTCCGAAATCGTGTTGACCCAGTCACCGGGAACCCTCTCGCTG TCCCCGGGAGAACGGGCTACACTGTCATGTAGAGCGTCCCAGTCCGTGGC TTCCTCGTTCCTGGCCTGGTACCAGCAGAAGCCGGGACAGGCACCCCGCC TGCTCATCTACGGAGCCAGCGGCCGGGCGACCGGCATCCCTGACCGCTTC TCCGGTTCCGGCTCGGGCACCGACTTTACTCTGACCATTAGCAGGCTTGA GCCCGAGGATTTTGCCGTGTACTACTGCCAACACTACGGGGGGAGCCCTC GCCTGACCTTCGGAGGCGGAACTAAGGTCGATATCAAAA |
| BCMA_EBB-C1978-G4-aa VH | 1179 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKMG WSSGYLGAFDIWGQGTTVTVSS |

TABLE 5-continued

Amino Acid and Nucleic Acid Sequences of exemplary anti-BCMA scFv domains and BCMA CAR molecules

| Name/ Description | SEQ ID NO: | Sequence |
| --- | --- | --- |
| BCMA_EBB-C1978-G4-aa VL | 1180 | EIVLTQSPGTLSLSPGERATLSCRASQSVASSFLAWYQQKPGQAPRLLIY GASGRATGIPDRFSGSGSGTDFTLTISRLEPEDFAVYYCQHYGGSPRLTF GGGTKVDIK |
| BCMA_EBB-C1978-G4-aa Full CART | 1181 | MALPVTALLLPLALLLHAARPEVQLVESGGGLVQPGGSLRLSCAASGFTF SSYAMSWVRQAPGKGLEWVSAISGSGGSTYYADSVKGRFTISRDNSKNTL YLQMNSLRAEDTAVYYCAKMGWSSGYLGAFDIWGQGTTVTVSSGGGGSGG GGSGGGGSEIVLTQSPGTLSLSPGERATLSCRASQSVASSFLAWYQQKPG QAPRLLIYGASGRATGIPDRFSGSGSGTDFTLTISRLEPEDFAVYYCQHY GGSPRLTFGGGTKVDIKTTTPAPRPPTPAPTIASQPLSLRPEACRPAAGG AVHTRGLDFACDIYIWAPLAGTCGVLLLSLVITLYCKRGRKKLLYIFKQP FMRPVQTTQEEDGCSCRFPEEEEGGCELRVKFSRSADAPAYKQGQNQLYN ELNLGRREEYDVLDKRRGRDPEMGGKPRRKNPQEGLYNELQKDKMAEAYS EIGMKGERRRGKGHDGLYQGLSTATKDTYDALHMQALPPR |
| BCMA_EBB-C1978-G4-nt Full CART | 1182 | ATGGCCCTCCCTGTCACCGCCCTGCTGCTTCCGCTGGCTCTTCTGCTCCA CGCCGCTCGGCCCGAAGTCCAACTGGTGGAGTCCGGGGGAGGGCTCGTGC AGCCCGGAGGCAGCCTTCGGCTGTCGTGCGCCGCCTCCGGGTTCACGTTC TCATCCTACGCGATGTCGTGGGTCAGACAGGCACCAGGAAAGGGACTGGA ATGGGTGTCCGCCATTAGCGGCTCCGGCGGTAGCACCTACTATGCCGACT CAGTGAAGGGAAGGTTCACTATCTCCCGCGACAACAGCAAGAACACCCTG TACCTCCAAATGAACTCTCTGCGGGCCGAGGATACCGCGGTGTACTATTG CGCCAAGATGGGTTGGTCCAGCGGATACTTGGGAGCCTTCGACATTTGGG GACAGGGCACTACTGTGACCGTGTCCTCCGGGGTGGCGGATCGGGAGGC GGCGGCTCGGGTGGAGGGGGTTCCGAAATCGTGTTGACCCAGTCACCGGG AACCCTCTCGCTGTCCCCGGGAGAACGGGCTACACTGTCATGTAGAGCGT CCCAGTCCGTGGCTTCCTCGTTCCTGGCTGGTACCAGCAGAAGCCGGGA CAGGCACCCCGCCTGCTCATCTACGGAGCCAGCGGCCGGGCGACCGGCAT CCCTGACCGCTTCTCCGGTTCCGGCTCGGGCACCGACTTTACTCTGACCA TTAGCAGGCTTGAGCCCGAGGATTTTGCCGTGTACTACTGCCAACACTAC GGGGGGAGCCCTCGCCTGACCTTCGGAGGCGGAACTAAGGTCGATATCAA AACCACTACCCCAGCACCGAGGCACCCACCCCGGCTCCTACCATCGCCT CCCAGCCTCTGTCCCTGCGTCCGGAGGCATGTAGACCCGCAGCTGGTGGG GCCGTGCATACCCGGGGTCTTGACTTCGCCTGCGATATCTACATTTGGGC CCCTCTGGCTGGTACTTGCGGGGTCCTGCTGCTTTCACTCGTGATCACTC TTTACTGTAAGCGCGGTCGGAAGAAGCTGCTGTACATCTTTAAGCAACCC TTCATGAGGCCTGTGCAGACTACTCAAGAGGAGGACGGCTGTTCATGCCG GTTCCCAGAGGAGGAGGAAGGCGGCTGCGAACTGCGCGTGAAATTCAGCC GCAGCGCAGATGCTCCAGCCTACAAGCAGGGGCAGAACCAGCTCTACAAC GAACTCAATCTTGGTCGGAGAGAGGAGTACGACGTGCTGGACAAGCGGAG AGGACGGGACCCAGAAATGGGCGGGAAGCCGCGCAGAAAGAATCCCCAAG AGGGCCTGTACAACGAGCTCCAAAAGGATAAGATGGCAGAAGCCTATAGC GAGATTGGTATGAAAGGGGAACGCAGAAGAGGCAAAGGCCACGACGGACT GTACCAGGGACTCAGCACCGCCACCAAGGACACCTATGACGCTCTTCACA TGCAGGCCCTGCCGCCTCGG |

TABLE 6

Additional exemplary BCMA CAR sequences

| Name | Sequence | SEQ ID NO: |
| --- | --- | --- |
| A7D12.2 VH | QIQLVQSGPDLKKPGETVKLSCKASGYTFTNFGMNWVKQAPGKGFKWMA WINTYTGESYFADDFKGRFAFSVETSATTAYLQINNLKTEDTATYFCAR GEIYYGYDGGFAYWGQGTLVTVSA | 1183 |
| A7D12.2 VL | DVVMTQSHRFMSTSVGDRVSITCRASQDVNTAVSWYQQKPGQSPKLLIF SASYRYTGVPDRFTGSGSGADFTLTISSVQAEDLAVYYCQQHYSTPWTF GGGTKLDIK | 1184 |
| A7D12.2 scFv domain | QIQLVQSGPDLKKPGETVKLSCKASGYTFTNFGMNWVKQAPGKGFKWMA WINTYTGESYFADDFKGRFAFSVETSATTAYLQINNLKTEDTATYFCAR GEIYYGYDGGFAYWGQGTLVTVSAGGGGSGGGGSGGGGSDVVMTQSHRF MSTSVGDRVSITCRASQDVNTAVSWYQQKPGQSPKLLIFSASYRYTGVP DRFTGSGSGADFTLTISSVQAEDLAVYYCQQHYSTPWTFGGGTKLDIK | 1185 |
| A7D12.2 Full CART | QIQLVQSGPDLKKPGETVKLSCKASGYTFTNFGMNWVKQAPGKGFKWMA WINTYTGESYFADDFKGRFAFSVETSATTAYLQINNLKTEDTATYFCAR | 1186 |

TABLE 6-continued

Additional exemplary BCMA CAR sequences

| Name | Sequence | SEQ ID NO: |
|---|---|---|
| | GEIYYGYDGGFAYWGQGTLVTVSAGGGGSGGGGSGGGGSDVVMTQSHRF MSTSVGDRVSITCRASQDVNTAVSWYQQKPGQSPKLLIFSASYRYTGVP DRFTGSGSGADFTLTISSVQAEDLAVYYCQQHYSTPWTFGGGTKLDIKT TTPAPRPPTPAPTIASQPLSLRPEACRPAAGGAVHTRGLDFACDIYIWA PLAGTCGVLLLSLVITLYCKRGRKKLLYIFKQPFMRPVQTTQEEDGCSC RFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGH DGLYQGLSTATKDTYDALHMQALPPR | |
| C11D5.3 VH | QIQLVQSGPELKKPGETVKISCKASGYTFTDYSINWVKRAPGKGLKWMG WINTETREPAYAYDFRGRFAFSLETSASTAYLQINNLKYEDTATYFCAL DYSYAMDYWGQGTSVTVSS | 1187 |
| C11D5.3 VL | DIVLTQSPASLAMSLGKRATISCRASESVSVIGAHLIHWYQQKPGQPPK LLIYLASNLETGVPARFSGSGSGTDFTLTIDPVEEDDVAIYSCLQSRIF PRTFGGGTKLEIK | 1188 |
| C11D5.3 scFv domain | QIQLVQSGPELKKPGETVKISCKASGYTFTDYSINWVKRAPGKGLKWMG WINTETREPAYAYDFRGRFAFSLETSASTAYLQINNLKYEDTATYFCAL DYSYAMDYWGQGTSVTVSSGGGGSGGGGSGGGGSQIQLVQSGPELKKPG ETVKISCKASGYTFTDYSINWVKRAPGKGLKWMGWINTETREPAYAYDF RGRFAFSLETSASTAYLQINNLKYEDTATYFCALDYSYAMDYWGQGTSV TVSS | 1189 |
| C11D5.3 Full CART | QIQLVQSGPELKKPGETVKISCKASGYTFTDYSINWVKRAPGKGLKWMG WINTETREPAYAYDFRGRFAFSLETSASTAYLQINNLKYEDTATYFCAL DYSYAMDYWGQGTSVTVSSGGGGSGGGGSGGGGSQIQLVQSGPELKKPG ETVKISCKASGYTFTDYSINWVKRAPGKGLKWMGWINTETREPAYAYDF RGRFAFSLETSASTAYLQINNLKYEDTATYFCALDYSYAMDYWGQGTSV TVSSTTTPAPRPPTPAPTIASQPLSLRPEACRPAAGGAVHTRGLDFACD IYIWAPLAGTCGVLLLSLVITLYCKRGRKKLLYIFKQPFMRPVQTTQEE DGCSCRFPEEEEGGCELRVKFSRSADAPAYKQGQNQLYNELNLGRREEY DVLDKRRGRDPEMGGKPRRKNPQEGLYNELQKDKMAEAYSEIGMKGERR RGKGHDGLYQGLSTATKDTYDALHMQALPPR | 1190 |
| C12A3.2 VH | QIQLVQSGPELKKPGETVKISCKASGYTFRHYSMNWVKQAPGKGLKWMG RINTESGVPIYADDFKGRFAFSVETSASTAYLVINNLKDEDTASYFCSN DYLYSLDFWGQGTALTVSS | 1191 |
| C12A3.2 VL | DIVLTQSPPSLAMSLGKRATISCRASESVTILGSHLIYWYQQKPGQPPT LLIQLASNVQTGVPARFSGSGSRTDFTLTIDPVEEDDVAVYYCLQSRTI PRTFGGGTKLEIK | 1192 |
| C12A3.2 scFv domain | QIQLVQSGPELKKPGETVKISCKASGYTFRHYSMNWVKQAPGKGLKWMG RINTESGVPIYADDFKGRFAFSVETSASTAYLVINNLKDEDTASYFCSN DYLYSLDFWGQGTALTVSSGGGGSGGGGSGGGGSDIVLTQSPPSLAMSL GKRATISCRASESVTILGSHLIYWYQQKPGQPPTLLIQLASNVQTGVPA RFSGSGSRTDFTLTIDPVEEDDVAVYYCLQSRTIPRTFGGGTKLEIK | 1193 |
| C12A3.2 Full CART | QIQLVQSGPELKKPGETVKISCKASGYTFRHYSMNWVKQAPGKGLKWMG RINTESGVPIYADDFKGRFAFSVETSASTAYLVINNLKDEDTASYFCSN DYLYSLDFWGQGTALTVSSGGGGSGGGGSGGGGSDIVLTQSPPSLAMSL GKRATISCRASESVTILGSHLIYWYQQKPGQPPTLLIQLASNVQTGVPA RFSGSGSRTDFTLTIDPVEEDDVAVYYCLQSRTIPRTFGGGTKLEIKTT TPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCR FPEEEEGGCELRVKFSRSADAPAYKQGQNQLYNELNLGRREEYDVLDKR RGRDPEMGGKPRRKNPQEGLYNELQKDKMAEAYSEIGMKGERRRGKGHD GLYQGLSTATKDTYDALHMQALPPR | 1194 |
| C13F12.1 VH | QIQLVQSGPELKKPGETVKISCKASGYTFTHYSMNWVKQAPGKGLKWMG RINTETGEPLYADDFKGRFAFSLETSASTAYLVINNLKNEDTATFFCSN DYLYSCDYWGQGTTLTVSS | 1195 |
| C13F12.1 VL | DIVLTQSPPSLAMSLGKRATISCRASESVTILGSHLIYWYQQKPGQPPT LLIQLASNVQTGVPARFSGSGSRTDFTLTIDPVEEDDVAVYYCLQSRTI PRTFGGGTKLEIK | 1196 |
| C13F12.1 scFv domain | QIQLVQSGPELKKPGETVKISCKASGYTFTHYSMNWVKQAPGKGLKWMG RINTETGEPLYADDFKGRFAFSLETSASTAYLVINNLKNEDTATFFCSN DYLYSCDYWGQGTTLTVSSGGGGSGGGGSGGGGSDIVLTQSPPSLAMSL GKRATISCRASESVTILGSHLIYWYQQKPGQPPTLLIQLASNVQTGVPA RFSGSGSRTDFTLTIDPVEEDDVAVYYCLQSRTIPRTFGGGTKLEIK | 1197 |

TABLE 6-continued

Additional exemplary BCMA CAR sequences

| Name | Sequence | SEQ ID NO: |
|---|---|---|
| C13F12.1 Full CART | QIQLVQSGPELKKPGETVKISCKASGYTFTHYSMNWVKQAPGKGLKWMG RINTETGEPLYADDFKGRFAFSLETSASTAYLVINNLKNEDTATFFCSN DYLYSCDYWGQGTTLTVSSGGGGSGGGGSGGGGSDIVLTQSPPSLAMSL GKRATISCRASESVTILGSHLIYWYQQKPGQPPTLLIQLASNVQTGVPA RFSGSGSRTDFTLTIDPVEEDDVAVYYCLQSRTIPRTFGGGTKLEIKTT TPAPRPPTPAPTIASQPLSLRPEACRPAAGGAVHTRGLDFACDIYIWAP LAGTCGVLLLSLVITLYCKRGRKKLLYIFKQPFMRPVQTTQEEDGCSCR FPEEEEGGCELRVKFSRSADAPAYKQGQNQLYNELNLGRREEYDVLDKR RGRDPEMGGKPRRKNPQEGLYNELQKDKMAEAYSEIGMKGERRRGKGHD GLYQGLSTATKDTYDALHMQALPPR | 1198 |

Exemplary BCMA CAR constructs disclose herein comprise an scFv (e.g., a scFv as disclosed in Table 5 or 6, optionally preceded with an optional leader sequence (e.g., SEQ ID NO: 401 and SEQ ID NO: 402 for exemplary leader amino acid and nucleotide sequences, respectively). The sequences of the scFv fragments (e.g., an ScFv from any of SEQ ID NOs: 967-1182, e.g., SEQ ID NOs: 967, 973, 979, 985, 991, 997, 1003, 1009, 1015, 1021, 1027, 1033, 1039, 1045, 1051, 1057, 1063, 1069, 1075, 1081, 1087, 1093, 1099, 1105, 1111, 1117, 1123, 1129, 1135, 1141, 1147, 1153, 1159, 1165, 1171, 1177, not including the optional leader sequence) are provided herein in Tables 5 or 6. The BCMA CAR construct can further include an optional hinge domain, e.g., a CD8 hinge domain (e.g., including the amino acid sequence of SEQ ID NO: 403 or encoded by a nucleic acid sequence of SEQ ID NO: 404); a transmembrane domain, e.g., a CD8 transmembrane domain (e.g., including the amino acid sequence of SEQ ID NO: 12 or encoded by the nucleotide sequence of SEQ ID NO: 13); an intracellular domain, e.g., a 4-1BB intracellular domain (e.g., including the amino acid sequence of SEQ ID NO: 14 or encoded by the nucleotide sequence of SEQ ID NO: 15; and a functional signaling domain, e.g., a CD3 zeta domain (e.g., including amino acid sequence of SEQ ID NO: 18 or 20, or encoded by the nucleotide sequence of SEQ ID NO: 19 or 21). In certain embodiments, the domains are contiguous with and in the same reading frame to form a single fusion protein. In other embodiments, the domain are in separate polypeptides, e.g., as in an RCAR molecule as described herein.

In certain embodiments, the full length BCMA CAR molecule includes the amino acid sequence of, or is encoded by the nucleotide sequence of, BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1 provided in Table 5 or 6, or a sequence substantially (e.g., 85%, 95-99% or higher) identical thereto.

In certain embodiments, the BCMA CAR molecule, or the anti-BCMA antigen binding domain, includes the scFv amino acid sequence of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1 provided in Table 5 or 6 (with or without the leader sequence), or a sequence substantially identical (e.g., 85%, 95-99% or higher identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes the heavy chain variable region and/or the light chain variable region of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1 provided in Table 5 or 6, or a sequence substantially identical (e.g., 85%, 95-99% or higher identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 7; and/or one, two or three CDRs from the light chain variable region (e.g., LCDR1, LCDR2 and/or LCDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, provided in Table 8; or a sequence substantially identical (e.g., 85%, 95-99% or higher identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 9; and/or one, two or three CDRs from the light chain variable region (e.g., LCDR1, LCDR2 and/or LCDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, provided in Table 10; or a sequence substantially identical (e.g., 85%, 95-99% or higher identical, or up to 20, 15, 10, 8, 6, 5, 4, 3, 2, or 1 amino acid changes, e.g., substitutions (e.g., conservative substitutions)) to any of the aforesaid sequences.

In certain embodiments, the BCMA CAR molecule, or the anti-BCMA antigen binding domain, includes one, two or three CDRs from the heavy chain variable region (e.g., HCDR1, HCDR2 and/or HCDR3), provided in Table 11; and/or one, two or three CDRs from the light chain variable region (e.g., LCDR1, LCDR2 and/or LCDR3) of BCMA-1, BCMA-2, BCMA-3, BCMA-4, BCMA-5, BCMA-6, BCMA-7, BCMA-8, BCMA-9, BCMA-10, BCMA-11, BCMA-12, BCMA-13, BCMA-14, BCMA-15, 149362, 149363, 149364, 149365, 149366, 149367, 149368, 149369, BCMA_EBB-C1978-A4, BCMA_EBB-C1978-G1, BCMA_EBB-C1979-C1, BCMA_EBB-C1978-C7, BCMA_EBB-C1978-D10, BCMA_EBB-C1979-C12, BCMA_EBB-C1980-G4, BCMA_EBB-C1980-D2, BCMA_EBB-C1978-A10, BCMA_EBB-C1978-D4, BCMA_EBB-C1980-A2, BCMA_EBB-C1981-C3, BCMA_EBB-C1978-G4, A7D12.2, C11D5.3, C12A3.2, or C13F12.1, provided in Table 12; or a sequence substantially identical (e.g., 85%, 95-99% or higher identical, or up to 20, 15, 10, 8, 6, 5, 4, 3, 2, or 1 amino acid changes, e.g., substitutions (e.g., conservative substitutions)) to any of the aforesaid sequences.

The sequences of human CDR sequences of the scFv domains are shown in Tables 7, 9, and 11 for the heavy chain variable domains and in Tables 8, 10, and 12 for the light chain variable domains. "ID" stands for the respective SEQ ID NO for each CDR.

TABLE 7

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| 139109 | NHGMS | 1199 | GIVYSGSTYYAASVKG | 1239 | HGGESDV | 1279 |
| 139103 | NYAMS | 1200 | GISRSGENTYYADSVKG | 1240 | SPAHYYGGMDV | 1280 |
| 139105 | DYAMH | 1201 | GISWNSGSIGYADSVKG | 1241 | HSFLAY | 1281 |
| 139111 | NHGMS | 1202 | GIVYSGSTYYAASVKG | 1242 | HGGESDV | 1282 |
| 139100 | NFGIN | 1203 | WINPKNNNTNYAQKFQG | 1243 | GPYYYQSYMDV | 1283 |
| 139101 | SDAMT | 1204 | VISGSGGTTYYADSVKG | 1244 | LDSSGYYYARGPRY | 1284 |
| 139102 | NYGIT | 1205 | WISAYNGNTNYAQKFQG | 1245 | GPYYYYMDV | 1285 |
| 139104 | NHGMS | 1206 | GIVYSGSTYYAASVKG | 1246 | HGGESDV | 1286 |
| 139106 | NHGMS | 1207 | GIVYSGSTYYAASVKG | 1247 | HGGESDV | 1287 |
| 139107 | NHGMS | 1208 | GIVYSGSTYYAASVKG | 1248 | HGGESDV | 1288 |
| 139108 | DYYMS | 1209 | YISSSGSTIYYADSVKG | 1249 | ESGDGMDV | 1289 |
| 139110 | DYYMS | 1210 | YISSSGNTIYYADSVKG | 1250 | STMVREDY | 1290 |
| 139112 | NHGMS | 1211 | GIVYSGSTYYAASVKG | 1251 | HGGESDV | 1291 |
| 139113 | NHGMS | 1212 | GIVYSGSTYYAASVKG | 1252 | HGGESDV | 1292 |
| 139114 | NHGMS | 1213 | GIVYSGSTYYAASVKG | 1253 | HGGESDV | 1293 |
| 149362 | SSYYYWG | 1214 | SIYYSGSAYYNPSLKS | 1254 | HWQEWPDAFDI | 1294 |
| 149363 | TSGMCVS | 1215 | RIDWDEDKFYSTSLKT | 1255 | SGAGGTSATAFDI | 1295 |
| 149364 | SYSMN | 1216 | SISSSSSYIYYADSVKG | 1256 | TIAAVYAFDI | 1296 |
| 149365 | DYYMS | 1217 | YISSSGSTIYYADSVKG | 1257 | DLRGAFDI | 1297 |

TABLE 7-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| 149366 | SHYIH | 1218 | MINPSGGVTAYSQTLQG | 1258 | EGSGSGWYFDF | 1298 |
| 149367 | SGGYYWS | 1219 | YIYYSGSTYYNPSLKS | 1259 | AGIAARLRGAFDI | 1299 |
| 149368 | SYAIS | 1220 | GIIPIFGTANYAQKFQG | 1260 | RGGYQLLRWDVGLLRSAFDI | 1300 |
| 149369 | SNSAAWN | 1221 | RTYYRSKWYSFYAISLKS | 1261 | SSPEGLFLYWFDP | 1301 |
| BCMA_EBB-C1978-A4 | SYAMS | 1222 | AISGSGGSTYYADSVKG | 1262 | VEGSGSLDY | 1302 |
| BCMA_EBB-C1978-G1 | RYPMS | 1223 | GISDSGVSTYYADSAKG | 1263 | RAGSEASDI | 1303 |
| BCMA_EBB-C1979-C1 | SYAMS | 1224 | AISGSGGSTYYADSVKG | 1264 | ATYKRELRYYYGMDV | 1304 |
| BCMA_EBB-C1978-C7 | SYAMS | 1225 | AISGSGGSTYYADSVKG | 1265 | ATYKRELRYYYGMDV | 1305 |
| BCMA_EBB-C1978-D10 | DYAMH | 1226 | GISWNSGSIGYADSVKG | 1266 | VGKAVPDV | 1306 |
| BCMA_EBB-C1979-C12 | DYAMH | 1227 | SINWKGNSLAYGDSVKG | 1267 | HQGVAYYNYAMDV | 1307 |
| BCMA_EBB-C1980-G4 | SYAMS | 1228 | AISGSGGSTYYADSVKG | 1268 | VVRDGMDV | 1308 |
| BCMA_EBB-C1980-D2 | SYAMS | 1229 | AISGSGGSTYYADSVKG | 1269 | IPQTGTFDY | 1309 |
| BCMA_EBB-C1978-A10 | SYAMS | 1230 | AISGSGGSTYYADSVKG | 1270 | ANYKRELRYYYGMDV | 1310 |
| BCMA_EBB-C1978-D4 | SYAMS | 1231 | AISGSGGSTYYADSVKG | 1271 | ALVGATGAFDI | 1311 |
| BCMA_EBB-C1980-A2 | SYAMS | 1232 | AISGSGGSTYYADSVKG | 1272 | WFGEGFDP | 1312 |
| BCMA_EBB-C1981-C3 | SYAMS | 1233 | AISGSGGSTYYADSVKG | 1273 | VGYDSSGYYRDYYGMDV | 1313 |
| BCMA_EBB-C1978-G4 | SYAMS | 1234 | AISGSGGSTYYADSVKG | 1274 | MGWSSGYLGAFDI | 1314 |
| A7D12.2 | NFGMN | 1235 | WINTYTGESYFADDFKG | 1275 | GEIYYGYDGGFAY | 1315 |
| C11D5.3 | DYSIN | 1236 | WINTETREPAYAYDFRG | 1276 | DYSYAMDY | 1316 |
| C12A3.2 | HYSMN | 1237 | RINTESGVPIYADDFKG | 1277 | DYLYSLDF | 1317 |
| C13F12.1 | HYSMN | 1238 | RINTETGEPLYADDFKG | 1278 | DYLYSCDY | 1318 |

TABLE 8

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| 139109 | RASQSISSYLN | 1319 | AASSLQS | 1359 | QQSYSTPYT | 1399 |
| 139103 | RASQSISSSFLA | 1320 | GASRRAT | 1360 | QQYHSSPSWT | 1400 |
| 139105 | RSSQSLLHSNGYNYLD | 1321 | LGSNRAS | 1361 | MQALQTPYT | 1401 |

TABLE 8-continued

Light Chain Variable Domain CDRs according to the Kabat
numbering scheme (Kabat et al. (1991), "Sequences of
Proteins of Immunological Interest," 5th Ed. Public Health
Service, National Institutes of Health, Bethesda, MD)

| Candidate | LCDR1 | ID | LCDR2 | ID | LCDR3 | ID |
|---|---|---|---|---|---|---|
| 139111 | KSSQSLLRNDGKTPLY | 1322 | EVSNRFS | 1362 | MQNIQFPS | 1402 |
| 139100 | RSSQSLLHSNGYNYLN | 1323 | LGSKRAS | 1363 | MQALQTPYT | 1403 |
| 139101 | RASQSISSYLN | 1324 | GASTLAS | 1364 | QQSYKRAS | 1404 |
| 139102 | RSSQSLLYSNGYNYVD | 1325 | LGSNRAS | 1365 | MQGRQFPYS | 1405 |
| 139104 | RASQSVSSNLA | 1326 | GASTRAS | 1366 | QQYGSSLT | 1406 |
| 139106 | RASQSVSSKLA | 1327 | GASIRAT | 1367 | QQYGSSSWT | 1407 |
| 139107 | RASQSVGSTNLA | 1328 | DASNRAT | 1368 | QQYGSSPPWT | 1408 |
| 139108 | RASQSISSYLN | 1329 | AASSLQS | 1369 | QQSYTLA | 1409 |
| 139110 | KSSESLVHNSGKTYLN | 1330 | EVSNRDS | 1370 | MQGTHWPGT | 1410 |
| 139112 | QASEDINKFLN | 1331 | DASTLQT | 1371 | QQYESLPLT | 1411 |
| 139113 | RASQSVGSNLA | 1332 | GASTRAT | 1372 | QQYNDWLPVT | 1412 |
| 139114 | RASQSIGSSSLA | 1333 | GASSRAS | 1373 | QQYAGSPPFT | 1413 |
| 149362 | KASQDIDDAMN | 1334 | SATSPVP | 1374 | LQHDNFPLT | 1414 |
| 149363 | RASQDIYNNLA | 1335 | AANKSQS | 1375 | QHYYRFPYS | 1415 |
| 149364 | RSSQSLLHSNGYNYLD | 1336 | LGSNRAS | 1376 | MQALQTPYT | 1416 |
| 149365 | GGNNIGTKSVH | 1337 | DDSVRPS | 1377 | QVWDSDSEHVV | 1417 |
| 149366 | SGDGLSKKYVS | 1338 | RDKERPS | 1378 | QAWDDTTVV | 1418 |
| 149367 | RASQGIRNWLA | 1339 | AASNLQS | 1379 | QKYNSAPFT | 1419 |
| 149368 | GGNNIGSKSVH | 1340 | GKNNRPS | 1380 | SSRDSSGDHLRV | 1420 |
| 149369 | QGDSLGNYYAT | 1341 | GTNNRPS | 1381 | NSRDSSGHHLL | 1421 |
| BCMA_EBB-C1978-A4 | RASQSVSSAYLA | 1342 | GASTRAT | 1382 | QHYGSSFNGSSLFT | 1422 |
| BCMA_EBB-C1978-G1 | RASQSVSNSLA | 1343 | DASSRAT | 1383 | QQFGTSSGLT | 1423 |
| BCMA_EBB-C1979-C1 | RASQSVSSSFLA | 1344 | GASSRAT | 1384 | QQYHSSPSWT | 1424 |
| BCMA_EBB-C1978-C7 | RASQSVSTTFLA | 1345 | GSSNRAT | 1385 | QQYHSSPSWT | 1425 |
| BCMA_EBB-C1978-D10 | RASQSISSYLN | 1346 | AASSLQS | 1386 | QQSYSTPYS | 1426 |
| BCMA_EBB-C1979-C12 | RATQSIGSSFLA | 1347 | GASQRAT | 1387 | QHYESSPSWT | 1427 |
| BCMA_EBB-C1980-G4 | RASQSVSSSYLA | 1348 | GASSRAT | 1388 | QQYGSPPRFT | 1428 |
| BCMA_EBB-C1980-D2 | RASQSVSSSYLA | 1349 | GASSRAT | 1389 | QHYGSSPSWT | 1429 |

TABLE 8-continued

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | ID | LCDR2 | ID | LCDR3 | ID |
|---|---|---|---|---|---|---|
| BCMA_EBB-C1978-A10 | RASQRVASNYLA | 1350 | GASSRAT | 1390 | QHYDSSPSWT | 1430 |
| BCMA_EBB-C1978-D4 | RASQSLSSNFLA | 1351 | GASNWAT | 1391 | QYYGTSPMYT | 1431 |
| BCMA_EBB-C1980-A2 | RSSQSLLHSNGYNYLD | 1352 | LGSNRAS | 1392 | MQALQTPLT | 1432 |
| BCMA_EBB-C1981-C3 | RASQSVSSSYLA | 1353 | GTSSRAT | 1393 | QHYGNSPPKFT | 1433 |
| BCMA_EBB-C1978-G4 | RASQSVASSFLA | 1354 | GASGRAT | 1394 | QHYGGSPRLT | 1434 |
| A7D12.2 | RASQDVNTAVS | 1355 | SASYRYT | 1395 | QQHYSTPWT | 1435 |
| C11D5.3 | RASESVSVIGAHLIH | 1356 | LASNLET | 1396 | LQSRIFPRT | 1436 |
| C12A3.2 | RASESVTILGSHLIY | 1357 | LASNVQT | 1397 | LQSRTIPRT | 1437 |
| C13F12.1 | RASESVTILGSHLIY | 1358 | LASNVQT | 1398 | LQSRTIPRT | 1438 |

TABLE 9

Heavy Chain Variable Domain CDRs according to the Chothia numbering scheme (Al-Lazikani et al., (1997) JMB 273, 927-948)

| Candidate | HCDR1 | ID | HCDR2 | ID | HCDR3 | ID |
|---|---|---|---|---|---|---|
| 139109 | GFALSNH | 1439 | VYSGS | 1479 | HGGESDV | 1519 |
| 139103 | GFTFSNY | 1440 | SRSGEN | 1480 | SPAHYYGGMDV | 1520 |
| 139105 | GFTFDDY | 1441 | SWNSGS | 1481 | HSFLAY | 1521 |
| 139111 | GFALSNH | 1442 | VYSGS | 1482 | HGGESDV | 1522 |
| 139100 | GYIFDNF | 1443 | NPKNNN | 1483 | GPYYYQSYMDV | 1523 |
| 139101 | GFTFSSD | 1444 | SGSGGT | 1484 | LDSSGYYYARGPRY | 1524 |
| 139102 | GYTFSNY | 1445 | SAYNGN | 1485 | GPYYYYMDV | 1525 |
| 139104 | GFALSNH | 1446 | VYSGS | 1486 | HGGESDV | 1526 |
| 139106 | GFALSNH | 1447 | VYSGS | 1487 | HGGESDV | 1527 |
| 139107 | GFALSNH | 1448 | VYSGS | 1488 | HGGESDV | 1528 |
| 139108 | GFTFSDY | 1449 | SSSGST | 1489 | ESGDGMDV | 1529 |
| 139110 | GFTFSDY | 1450 | SSSGNT | 1490 | STMVREDY | 1530 |
| 139112 | GFALSNH | 1451 | VYSGS | 1491 | HGGESDV | 1531 |
| 139113 | GFALSNH | 1452 | VYSGS | 1492 | HGGESDV | 1532 |
| 139114 | GFALSNH | 1453 | VYSGS | 1493 | HGGESDV | 1533 |
| 149362 | GGSISSSYY | 1454 | YYSGS | 1494 | HWQEWPDAFDI | 1534 |
| 149363 | GFSLRTSGM | 1455 | DWDED | 1495 | SGAGGTSATAFDI | 1535 |

TABLE 9-continued

Heavy Chain Variable Domain CDRs according to the Chothia numbering scheme (Al-Lazikani et al., (1997) JMB 273, 927-948)

| Candidate | HCDR1 | ID | HCDR2 | ID | HCDR3 | ID |
|---|---|---|---|---|---|---|
| 149364 | GFTFSSY | 1456 | SSSSSY | 1496 | TIAAVYAFDI | 1536 |
| 149365 | GFTFSDY | 1457 | SSSGST | 1497 | DLRGAFDI | 1537 |
| 149366 | GYTVTSH | 1458 | NPSGGV | 1498 | EGSGSGWYFDF | 1538 |
| 149367 | GGSISSGGY | 1459 | YYSGS | 1499 | AGIAARLRGAFDI | 1539 |
| 149368 | GGTFSSY | 1460 | IPIFGT | 1500 | RGGYQLLRWDVGLLRSAFDI | 1540 |
| 149369 | GDSVSSNSA | 1461 | YYRSKWY | 1501 | SSPEGLFLYWFDP | 1541 |
| BCMA_EBB-C1978-A4 | GFTFSSY | 1462 | SGSGGS | 1502 | VEGSGSLDY | 1542 |
| BCMA_EBB-C1978-G1 | GITFSRY | 1463 | SDSGVS | 1503 | RAGSEASDI | 1543 |
| BCMA_EBB-C1979-C1 | GFTFSSY | 1464 | SGSGGS | 1504 | ATYKRELRYYYGMDV | 1544 |
| BCMA_EBB-C1978-C7 | GFTFSSY | 1465 | SGSGGS | 1505 | ATYKRELRYYYGMDV | 1545 |
| BCMA_EBB-C1978-D10 | GFTFDDY | 1466 | SWNSGS | 1506 | VGKAVPDV | 1546 |
| BCMA_EBB-C1979-C12 | GFTFDDY | 1467 | NWKGNS | 1507 | HQGVAYYNYAMDV | 1547 |
| BCMA_EBB-C1980-G4 | GFTFSSY | 1468 | SGSGGS | 1508 | VVRDGMDV | 1548 |
| BCMA_EBB-C1980-D2 | GFTFSSY | 1469 | SGSGGS | 1509 | IPQTGTFDY | 1549 |
| BCMA_EBB-C1978-A10 | GFTFSSY | 1470 | SGSGGS | 1510 | ANYKRELRYYYGMDV | 1550 |
| BCMA_EBB-C1978-D4 | GFSFSSY | 1471 | SGSGGS | 1511 | ALVGATGAFDI | 1551 |
| BCMA_EBB-C1980-A2 | GFTFSSY | 1472 | SGSGGS | 1512 | WFGEGFDP | 1552 |
| BCMA_EBB-C1981-C3 | GFTFSSY | 1473 | SGSGGS | 1513 | VGYDSSGYYRDYYGMDV | 1553 |
| BCMA_EBB-C1978-G4 | GFTFSSY | 1474 | SGSGGS | 1514 | MGWSSGYLGAFDI | 1554 |
| A7D12.2 | GYTFTNF | 1475 | NTYTGE | 1515 | GEIYYGYDGGFAY | 1555 |
| C11D5.3 | GYTFTDY | 1476 | NTETRE | 1516 | DYSYAMDY | 1556 |
| C12A3.2 | GYTFRHY | 1477 | NTESGV | 1517 | DYLYSLDF | 1557 |
| C13F12.1 | GYTFTHY | 1478 | NTETGE | 1518 | DYLYSCDY | 1558 |

TABLE 10

Light Chain Variable Domain CDRs according to the Chothia numbering scheme (Al-Lazikani et al., (1997) JMB 273, 927-948)

| Candidate | LCDR1 | ID | LCDR2 | ID | LCDR3 | ID |
|---|---|---|---|---|---|---|
| 139109 | SQSISSY | 1559 | AAS | 1599 | SYSTPY | 1639 |
| 139103 | SQSISSSF | 1560 | GAS | 1600 | YHSSPSW | 1640 |

TABLE 10-continued

Light Chain Variable Domain CDRs according to the
Chothia numbering scheme (Al-Lazikani et al., (1997)
JMB 273, 927-948)

| Candidate | LCDR1 | ID | LCDR2 | ID | LCDR3 | ID |
|---|---|---|---|---|---|---|
| 139105 | SQSLLHSNGYNY | 1561 | LGS | 1601 | ALQTPY | 1641 |
| 139111 | SQSLLRNDGKTP | 1562 | EVS | 1602 | NIQFP | 1642 |
| 139100 | SQSLLHSNGYNY | 1563 | LGS | 1603 | ALQTPY | 1643 |
| 139101 | SQSISSY | 1564 | GAS | 1604 | SYKRA | 1644 |
| 139102 | SQSLLYSNGYNY | 1565 | LGS | 1605 | GRQFPY | 1645 |
| 139104 | SQSVSSN | 1566 | GAS | 1606 | YGSSL | 1646 |
| 139106 | SQSVSSK | 1567 | GAS | 1607 | YGSSSW | 1647 |
| 139107 | SQSVGSTN | 1568 | DAS | 1608 | YGSSPPW | 1648 |
| 139108 | SQSISSY | 1569 | AAS | 1609 | SYTL | 1649 |
| 139110 | SESLVHNSGKTY | 1570 | EVS | 1610 | GTHWPG | 1650 |
| 139112 | SEDINKF | 1571 | DAS | 1611 | YESLPL | 1651 |
| 139113 | SQSVGSN | 1572 | GAS | 1612 | YNDWLPV | 1652 |
| 139114 | SQSIGSSS | 1573 | GAS | 1613 | YAGSPPF | 1653 |
| 149362 | SQDIDDA | 1574 | SAT | 1614 | HDNFPL | 1654 |
| 149363 | SQDIYNN | 1575 | AAN | 1615 | YYRFPY | 1655 |
| 149364 | SQSLLHSNGYNY | 1576 | LGS | 1616 | ALQTPY | 1656 |
| 149365 | NNIGTKS | 1577 | DDS | 1617 | WDSDEHV | 1657 |
| 149366 | DGLSKKY | 1578 | RDK | 1618 | WDDTTV | 1658 |
| 149367 | SQGIRNW | 1579 | AAS | 1619 | YNSAPF | 1659 |
| 149368 | NNIGSKS | 1580 | GKN | 1620 | RDSSGDHLR | 1660 |
| 149369 | DSLGNYY | 1581 | GTN | 1621 | RDSSGHHL | 1661 |
| BCMA_EBB-C1978-A4 | SQSVSSAY | 1582 | GAS | 1622 | YGSSFNGSSLF | 1662 |
| BCMA_EBB-C1978-G1 | SQSVSNS | 1583 | DAS | 1623 | FGTSSGL | 1663 |
| BCMA_EBB-C1979-C1 | SQSVSSSF | 1584 | GAS | 1624 | YHSSPSW | 1664 |
| BCMA_EBB-C1978-C7 | SQSVSTTF | 1585 | GSS | 1625 | YHSSPSW | 1665 |
| BCMA_EBB-C1978-D10 | SQSISSY | 1586 | AAS | 1626 | SYSTPY | 1666 |
| BCMA_EBB-C1979-C12 | TQSIGSSF | 1587 | GAS | 1627 | YESSPSW | 1667 |
| BCMA_EBB-C1980-G4 | SQSVSSSY | 1588 | GAS | 1628 | YGSPPRF | 1668 |
| BCMA_EBB-C1980-D2 | SQSVSSSY | 1589 | GAS | 1629 | YGSSPSW | 1669 |
| BCMA_EBB-C1978-A10 | SQRVASNY | 1590 | GAS | 1630 | YDSSPSW | 1670 |
| BCMA_EBB-C1978-D4 | SQSLSSNF | 1591 | GAS | 1631 | YGTSPMY | 1671 |

TABLE 10-continued

Light Chain Variable Domain CDRs according to the Chothia numbering scheme (Al-Lazikani et al., (1997) JMB 273, 927-948)

| Candidate | LCDR1 | ID | LCDR2 | ID | LCDR3 | ID |
|---|---|---|---|---|---|---|
| BCMA_EBB-C1980-A2 | SQSLLHSNGYNY | 1592 | LGS | 1632 | ALQTPL | 1672 |
| BCMA_EBB-C1981-C3 | SQSVSSSY | 1593 | GTS | 1633 | YGNSPPKF | 1673 |
| BCMA_EBB-C1978-G4 | SQSVASSF | 1594 | GAS | 1634 | YGGSPRL | 1674 |
| A7D12.2 | SQDVNTA | 1595 | SAS | 1635 | HYSTPW | 1675 |
| C11D5.3 | SESVSVIGAHL | 1596 | LAS | 1636 | SRIFPR | 1676 |
| C12A3.2 | SESVTILGSHL | 1597 | LAS | 1637 | SRTIPR | 1677 |
| C13F12.1 | SESVTILGSHL | 1598 | LAS | 1638 | SRTIPR | 1678 |

TABLE 11

Heavy Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273, 927-948).

| Candidate | HCDR1 | ID | HCDR2 | ID | HCDR3 | ID |
|---|---|---|---|---|---|---|
| 139109 | GFALSNHGMS | 1679 | GIVYSGSTYYAASVKG | 1719 | HGGESDV | 1759 |
| 139103 | GFTFSNYAMS | 1680 | GISRSGENTYYADSVKG | 1720 | SPAHYYGGMDV | 1760 |
| 139105 | GFTFDDYAMH | 1681 | GISWNSGSIGYADSVKG | 1721 | HSFLAY | 1761 |
| 139111 | GFALSNHGMS | 1682 | GIVYSGSTYYAASVKG | 1722 | HGGESDV | 1762 |
| 139100 | GYIFDNFGIN | 1683 | WINPKNNNTNYAQKFQG | 1723 | GPYYYQSYMDV | 1763 |
| 139101 | GFTFSSDAMT | 1684 | VISGSGGTTYYADSVKG | 1724 | LDSSGYYYARGPRY | 1764 |
| 139102 | GYTFSNYGIT | 1685 | WISAYNGNTNYAQKFQG | 1725 | GPYYYYMDV | 1765 |
| 139104 | GFALSNHGMS | 1686 | GIVYSGSTYYAASVKG | 1726 | HGGESDV | 1766 |
| 139106 | GFALSNHGMS | 1687 | GIVYSGSTYYAASVKG | 1727 | HGGESDV | 1767 |
| 139107 | GFALSNHGMS | 1688 | GIVYSGSTYYAASVKG | 1728 | HGGESDV | 1768 |
| 139108 | GFTFSDYYMS | 1689 | YISSSGSTIYYADSVKG | 1729 | ESGDGMDV | 1769 |
| 139110 | GFTFSDYYMS | 1690 | YISSSGNTIYYADSVKG | 1730 | STMVREDY | 1770 |
| 139112 | GFALSNHGMS | 1691 | GIVYSGSTYYAASVKG | 1731 | HGGESDV | 1771 |
| 139113 | GFALSNHGMS | 1692 | GIVYSGSTYYAASVKG | 1732 | HGGESDV | 1772 |

TABLE 11-continued

Heavy Chain Variable Domain CDRs according to a combination of the Kabat numbering scheme (Kabat et al. (1991), "Sequences of Proteins of Immunological Interest," 5th Ed. Public Health Service, National Institutes of Health, Bethesda, MD) and the Chothia numbering scheme (Al-Lazikani et al., (1997) JMB 273, 927-948).

| Candidate | HCDR1 | ID | HCDR2 | ID | HCDR3 | ID |
|---|---|---|---|---|---|---|
| 139114 | GFALSNHGMS | 1693 | GIVYSGSTYYAASVKG | 1733 | HGGESDV | 1773 |
| 149362 | GGSISSSYYYWG | 1694 | SIYYSGSAYYNPSLKS | 1734 | HWQEWPDAFDI | 1774 |
| 149363 | GFSLRTSGMCVS | 1695 | RIDWDEDKFYSTSLKT | 1735 | SGAGGTSATAFDI | 1775 |
| 149364 | GFTFSSYSMN | 1696 | SISSSSSYIYYADSVKG | 1736 | TIAAVYAFDI | 1776 |
| 149365 | GFTFSDYYMS | 1697 | YISSSGSTIYYADSVKG | 1737 | DLRGAFDI | 1777 |
| 149366 | GYTVTSHYIH | 1698 | MINPSGGVTAYSQTLQG | 1738 | EGSGSGWYFDF | 1778 |
| 149367 | GGSISSGGYYWS | 1699 | YIYYSGSTYYNPSLKS | 1739 | AGIAARLRGAFDI | 1779 |
| 149368 | GGTFSSYAIS | 1700 | GIIPIFGTANYAQKFQG | 1740 | RGGYQLLRWDVGLLRSAFDI | 1780 |
| 149369 | GDSVSSNSAAWN | 1701 | RTYYRSKWYSFYAISLKS | 1741 | SSPEGLFLYWFDP | 1781 |
| BCMA_EBB-C1978-A4 | GFTFSSYAMS | 1702 | AISGSGGSTYYADSVKG | 1742 | VEGSGSLDY | 1782 |
| BCMA_EBB-C1978-G1 | GITFSRYPMS | 1703 | GISDSGVSTYYADSAKG | 1743 | RAGSEASDI | 1783 |
| BCMA_EBB-C1979-C1 | GFTFSSYAMS | 1704 | AISGSGGSTYYADSVKG | 1744 | ATYKRELRYYYGMDV | 1784 |
| BCMA_EBB-C1978-C7 | GFTFSSYAMS | 1705 | AISGSGGSTYYADSVKG | 1745 | ATYKRELRYYYGMDV | 1785 |
| BCMA_EBB-C1978-D10 | GFTFDDYAMH | 1706 | GISWNSGSIGYADSVKG | 1746 | VGKAVPDV | 1786 |
| BCMA_EBB-C1979-C12 | GFTFDDYAMH | 1707 | SINVVKGNSLAYGDSVKG | 1747 | HQGVAYYNYAMDV | 1787 |
| BCMA_EBB-C1980-G4 | GFTFSSYAMS | 1708 | AISGSGGSTYYADSVKG | 1748 | VVRDGMDV | 1788 |
| BCMA_EBB-C1980-D2 | GFTFSSYAMS | 1709 | AISGSGGSTYYADSVKG | 1749 | IPQTGTFDY | 1789 |
| BCMA_EBB-C1978-A10 | GFTFSSYAMS | 1710 | AISGSGGSTYYADSVKG | 1750 | ANYKRELRYYYGMDV | 1790 |
| BCMA_EBB-C1978-D4 | GFSFSSYAMS | 1711 | AISGSGGSTYYADSVKG | 1751 | ALVGATGAFDI | 1791 |
| BCMA_EBB-C1980-A2 | GFTFSSYAMS | 1712 | AISGSGGSTYYADSVKG | 1752 | WFGEGFDP | 1792 |
| BCMA_EBB-C1981-C3 | GFTFSSYAMS | 1713 | AISGSGGSTYYADSVKG | 1753 | VGYDSSGYYRDYYGMDV | 1793 |
| BCMA_EBB-C1978-G4 | GFTFSSYAMS | 1714 | AISGSGGSTYYADSVKG | 1754 | MGWSSGYLGAFDI | 1794 |
| A7D12.2 | GYTFTNFGMN | 1715 | WINTYTGESYFADDFKG | 1755 | GEIYYGYDGGFAY | 1795 |
| C11D5.3 | GYTFTDYSIN | 1716 | WINTETREPAYAYDFRG | 1756 | DYSYAMDY | 1796 |

TABLE 11-continued

Heavy Chain Variable Domain CDRs according to a combination
of the Kabat numbering scheme (Kabat et al. (1991),
"Sequences of Proteins of Immunological Interest,"
5th Ed. Public Health Service, National Institutes of Health,
Bethesda, MD) and the Chothia numbering scheme
(Al-Lazikani et al., (1997) JMB 273, 927-948).

| Candidate | HCDR1 | ID | HCDR2 | ID | HCDR3 | ID |
|---|---|---|---|---|---|---|
| C12A3.2 | GYTFRHYSMN | 1717 | RINTESGVPIYADDFKG | 1757 | DYLYSLDF | 1797 |
| C13F12.1 | GYTFTHYSMN | 1718 | RINTETGEPLYADDFKG | 1758 | DYLYSCDY | 1798 |

TABLE 12

Light Chain Variable Domain CDRs according to a combination
of the Kabat numbering scheme (Kabat et al. (1991),
"Sequences of Proteins of Immunological Interest,"
5th Ed. Public Health Service, National Institutes of
Health, Bethesda, MD) and the Chothia numbering scheme
(Al-Lazikani et al., (1997) JMB 273, 927-948).

| Candidate | LCDR1 | ID | LCDR2 | ID | LCDR3 | ID |
|---|---|---|---|---|---|---|
| 139109 | RASQSISSYLN | 1799 | AASSLQS | 1839 | QQSYSTPYT | 1879 |
| 139103 | RASQSISSSFLA | 1800 | GASRRAT | 1840 | QQYHSSPSWT | 1880 |
| 139105 | RSSQSLLHSNGYNYLD | 1801 | LGSNRAS | 1841 | MQALQTPYT | 1881 |
| 139111 | KSSQSLLRNDGKTPLY | 1802 | EVSNRFS | 1842 | MQNIQFPS | 1882 |
| 139100 | RSSQSLLHSNGYNYLN | 1803 | LGSKRAS | 1843 | MQALQTPYT | 1883 |
| 139101 | RASQSISSYLN | 1804 | GASTLAS | 1844 | QQSYKRAS | 1884 |
| 139102 | RSSQSLLYSNGYNYVD | 1805 | LGSNRAS | 1845 | MQGRQFPYS | 1885 |
| 139104 | RASQSVSSNLA | 1806 | GASTRAS | 1846 | QQYGSSLT | 1886 |
| 139106 | RASQSVSSKLA | 1807 | GASIRAT | 1847 | QQYGSSSWT | 1887 |
| 139107 | RASQSVGSTNLA | 1808 | DASNRAT | 1848 | QQYGSSPPWT | 1888 |
| 139108 | RASQSISSYLN | 1809 | AASSLQS | 1849 | QQSYTLA | 1889 |
| 139110 | KSSESLVHNSGKTYLN | 1810 | EVSNRDS | 1850 | MQGTHWPGT | 1890 |
| 139112 | QASEDINKFLN | 1811 | DASTLQT | 1851 | QQYESLPLT | 1891 |
| 139113 | RASQSVGSNLA | 1812 | GASTRAT | 1852 | QQYNDWLPVT | 1892 |
| 139114 | RASQSIGSSSLA | 1813 | GASSRAS | 1853 | QQYAGSPPFT | 1893 |
| 149362 | KASQDIDDAMN | 1814 | SATSPVP | 1854 | LQHDNFPLT | 1894 |
| 149363 | RASQDIYNNLA | 1815 | AANKSQS | 1855 | QHYYRFPYS | 1895 |
| 149364 | RSSQSLLHSNGYNYLD | 1816 | LGSNRAS | 1856 | MQALQTPYT | 1896 |
| 149365 | GGNNIGTKSVH | 1817 | DDSVRPS | 1857 | QVWDSDSEHVV | 1897 |
| 149366 | SGDGLSKKYVS | 1818 | RDKERPS | 1858 | QAWDDTTVV | 1898 |
| 149367 | RASQGIRNWLA | 1819 | AASNLQS | 1859 | QKYNSAPFT | 1899 |
| 149368 | GGNNIGSKSVH | 1820 | GKNNRPS | 1860 | SSRDSSGDHLRV | 1900 |
| 149369 | QGDSLGNYYAT | 1821 | GTNNRPS | 1861 | NSRDSSGHHLL | 1901 |
| BCMA_EBB-C1978-A4 | RASQSVSSAYLA | 1822 | GASTRAT | 1862 | QHYGSSFNGSSLFT | 1902 |

TABLE 12-continued

Light Chain Variable Domain CDRs according to a combination
of the Kabat numbering scheme (Kabat et al. (1991),
"Sequences of Proteins of Immunological Interest,"
5th Ed. Public Health Service, National Institutes of
Health, Bethesda, MD) and the Chothia numbering scheme
(Al-Lazikani et al., (1997) JMB 273, 927-948).

| Candidate | LCDR1 | ID | LCDR2 | ID | LCDR3 | ID |
|---|---|---|---|---|---|---|
| BCMA_EBB-C1978-G1 | RASQSVSNSLA | 1823 | DASSRAT | 1863 | QQFGTSSGLT | 1903 |
| BCMA_EBB-C1979-C1 | RASQSVSSSFLA | 1824 | GASSRAT | 1864 | QQYHSSPSWT | 1904 |
| BCMA_EBB-C1978-C7 | RASQSVSTTFLA | 1825 | GSSNRAT | 1865 | QQYHSSPSWT | 1905 |
| BCMA_EBB-C1978-D10 | RASQSISSYLN | 1826 | AASSLQS | 1866 | QQSYSTPYS | 1906 |
| BCMA_EBB-C1979-C12 | RATQSIGSSFLA | 1827 | GASQRAT | 1867 | QHYESSPSWT | 1907 |
| BCMA_EBB-C1980-G4 | RASQSVSSSYLA | 1828 | GASSRAT | 1868 | QQYGSPPRFT | 1908 |
| BCMA_EBB-C1980-D2 | RASQSVSSSYLA | 1829 | GASSRAT | 1869 | QHYGSSPSWT | 1909 |
| BCMA_EBB-C1978-A10 | RASQRVASNYLA | 1830 | GASSRAT | 1870 | QHYDSSPSWT | 1910 |
| BCMA_EBB-C1978-D4 | RASQSLSSNFLA | 1831 | GASNWAT | 1871 | QYYGTSPMYT | 1911 |
| BCMA_EBB-C1980-A2 | RSSQSLLHSNGYNYLD | 1832 | LGSNRAS | 1872 | MQALQTPLT | 1912 |
| BCMA_EBB-C1981-C3 | RASQSVSSSYLA | 1833 | GTSSRAT | 1873 | QHYGNSPPKFT | 1913 |
| BCMA_EBB-C1978-G4 | RASQSVASSFLA | 1834 | GASGRAT | 1874 | QHYGGSPRLT | 1914 |
| A7D12.2 | RASQDVNTAVS | 1835 | SASYRYT | 1875 | QQHYSTPWT | 1915 |
| C11D5.3 | RASESVSVIGAHLIH | 1836 | LASNLET | 1876 | LQSRIFPRT | 1916 |
| C12A3.2 | RASESVTILGSHLIY | 1837 | LASNVQT | 1877 | LQSRTIPRT | 1917 |
| C13F12.1 | RASESVTILGSHLIY | 1838 | LASNVQT | 1878 | LQSRTIPRT | 1918 |

In certain embodiments, the CAR molecule described herein (e.g., the CAR nucleic acid or the CAR polypeptide) or a BCMA binding domain includes:

(1) one, two, or three light chain (LC) CDRs chosen from one of the following:
 (i) a LC CDR1 of SEQ ID NO: 1320, LC CDR2 of SEQ ID NO: 1360 and LC CDR3 of SEQ ID NO: 1400 of BCMA-4 CAR (139103);
 (ii) a LC CDR1 of SEQ ID NO: 1319, LC CDR2 of SEQ ID NO: 1359 and LC CDR3 of SEQ ID NO: 1399 of BCMA-10 CAR (139109);
 (iii) a LC CDR1 of SEQ ID NO: 1331, LC CDR2 of SEQ ID NO: 137 land LC CDR3 of SEQ ID NO: 1411 of BCMA-13 CAR (139112); or
 (iv) a LC CDR1 of SEQ ID NO: 1333, LC CDR2 of SEQ ID NO: 1373 and LC CDR3 of SEQ ID NO: 1413 of BCMA-15 CAR (139114), and/or (2) one, two, or three heavy chain (HC) CDRs from one of the following:
 (i) a HC CDR1 of SEQ ID NO: 1200, HC CDR2 of SEQ ID NO: 1240 and HC CDR3 of SEQ ID NO: 1280 of BCMA-4 CAR (139103);
 (ii) a HC CDR1 of SEQ ID NO: 1199, HC CDR2 of SEQ ID NO: 1239 and HC CDR3 of SEQ ID NO: 1279 of BCMA-10 CAR (139109);
 (iii) a HC CDR1 of SEQ ID NO: 1121, HC CDR2 of SEQ ID NO: 1251 and HC CDR3 of SEQ ID NO: 1291 of BCMA-13 CAR (139112); or
 (iv) a HC CDR1 of SEQ ID NO: 1213, HC CDR2 of SEQ ID NO: 1253 and HC CDR3 of SEQ ID NO: 1293 of BCMA-15 (139114).

In certain embodiments, the CAR molecule described herein (e.g., the CAR nucleic acid or the CAR polypeptide) includes:

(1) one, two, or three light chain (LC) CDRs chosen from one of the following:
 (i) a LC CDR1 of SEQ ID NO: 1560, LC CDR2 of SEQ ID NO: 1600 and LC CDR3 of SEQ ID NO: 1640 of BCMA-4 CAR (139103);
 (ii) a LC CDR1 of SEQ ID NO: 1559, LC CDR2 of SEQ ID NO: 1599 and LC CDR3 of SEQ ID NO: 1639 of BCMA-10 CAR (139109);

(iii) a LC CDR1 of SEQ ID NO: 1571, LC CDR2 of SEQ ID NO: 1611 and LC CDR3 of SEQ ID NO: 1651 of BCMA-13 CAR (139112); or (iv) a LC CDR1 of SEQ ID NO: 1573, LC CDR2 of SEQ ID NO: 1613 and LC CDR3 of SEQ ID NO: 1653 of BCMA-15 CAR (139114); and/or (2) one, two, or three heavy chain (HC) CDRs chosen from one of the following:

(i) a HC CDR1 of SEQ ID NO: 1440, HC CDR2 of SEQ ID NO: 1480 and HC CDR3 of SEQ ID NO: 1520 of BCMA-4 CAR (139103);

(ii) a HC CDR1 of SEQ ID NO: 1439, HC CDR2 of SEQ ID NO: 1479 and HC CDR3 of SEQ ID NO: 1519 of BCMA-10 CAR (139109);

(iii) a HC CDR1 of SEQ ID NO: 1451, HC CDR2 of SEQ ID NO: 1491 and HC CDR3 of SEQ ID NO: 1531 of BCMA-13 CAR (139112); or (iv) a HC CDR1 of SEQ ID NO: 1453, HC CDR2 of SEQ ID NO: 1493 and HC CDR3 of SEQ ID NO: 1533 of BCMA-15 CAR (139114).

In certain embodiments, the CAR molecule described herein (e.g., the CAR nucleic acid or the CAR polypeptide) includes:

(1) one, two, or three light chain (LC) CDRs chosen from one of the following:

(i) a LC CDR1 of SEQ ID NO: 1800 LC CDR2 of SEQ ID NO: 1840 and LC CDR3 of SEQ ID NO: 1880 of BCMA-4 CAR (139103);

(ii) a LC CDR1 of SEQ ID NO: 1799, LC CDR2 of SEQ ID NO: 1839 and LC CDR3 of SEQ ID NO: 1879 of BCMA-10 CAR (139109);

(iii) a LC CDR1 of SEQ ID NO: 1811, LC CDR2 of SEQ ID NO: 1851 and LC CDR3 of SEQ ID NO: 1891 of BCMA-13 CAR (139112); or (iv) a LC CDR1 of SEQ ID NO: 1813, LC CDR2 of SEQ ID NO: 1853 and LC CDR3 of SEQ ID NO: 1893 of BCMA-15 CAR (139114); and/or (2) one, two, or three heavy chain (HC) CDRs chosen from one of the following:

(i) a HC CDR1 of SEQ ID NO: 1680, HC CDR2 of SEQ ID NO: 1720 and HC CDR3 of SEQ ID NO: 1760 of BCMA-4 CAR (139103);

(ii) a HC CDR1 of SEQ ID NO: 1679, HC CDR2 of SEQ ID NO: 1719 and HC CDR3 of SEQ ID NO: 1759 of BCMA-10 CAR (139109);

(iii) a HC CDR1 of SEQ ID NO: 1691, HC CDR2 of SEQ ID NO: 1731 and HC CDR3 of SEQ ID NO: 1771 of BCMA-13 CAR (139112);

(iv) a HC CDR1 of SEQ ID NO: 1693, HC CDR2 of SEQ ID NO: 1733 and HC CDR3 of SEQ ID NO: 1773 of BCMA-15 CAR (139114).

Exemplary components of the CAR molecules:

Leader (amino acid sequence)
(SEQ ID NO: 1919)
MALPVTALLLPLALLLHAARP leader (nucleic acid sequence)
(SEQ ID NO: 1920)
ATGGCCCTGCCTGTGACAGCCCTGCTGCTGCCTCTGGCTCTGCTGCTGCA

TGCCGCTAGACCC leader (nucleic acid sequence)
(SEQ ID NO: 1943)
ATGGCCCTCCCTGTCACCGCCCTGCTGCTTCCGCTGGCTCTTCTGCTCCA

CGCCGCTCGGCCC

CD8 hinge (amino acid sequence)
(SEQ ID NO: 1921)
TTTPAPRPPTPAPTIASQPLSLRPEACRPAAGGAVHTRGLDFACD CD8 hinge (nucleic acid sequence)
(SEQ ID NO: 1922)
ACCACGACGCCAGCGCCGCGACCACCAACACCGGCGCCCACCATCGCGTC

GCAGCCCCTGTCCCTGCGCCCAGAGGCGTGCCGGCCAGCGGCGGGGGGCG

CAGTGCACACGAGGGGGCTGGACTTCGCCTGTGAT

CD8 transmembrane (amino acid sequence)
(SEQ ID NO: 1923)
IYIWAPLAGTCGVLLLSLVITLYC CD8 transmembrane (nucleic acid sequence)
(SEQ ID NO: 1924)
ATCTACATCTGGGCGCCCTTGGCCGGGACTTGTGGGGTCCTTCTCCTGTC

ACTGGTTATCACCCTTTACTGC

CD8 transmembrane (nucleic acid sequence)
(SEQ ID NO: 1944)
ATCTACATTTGGGCCCCTCTGGCTGGTACTTGCGGGGTCCTGCTGCTTTC

ACTCGTGATCACTCTTTACTGT 4-1BB Intracellular domain (amino acid sequence)
(SEQ ID NO: 1925)
KRGRKKLLYIFKQPFMRPVQTTQEEDGCSCRFPEEEEGGCEL 4-1BB Intracellular domain
(nucleic acid sequence)
(SEQ ID NO: 1926)
AAACGGGGCAGAAAGAAACTCCTGTATATATTCAAACAACCATTTATGAG

ACCAGTACAAACTACTCAAGAGGAAGATGGCTGTAGCTGCCGATTTCCAG

AAGAAGAAGAAGGAGGATGTGAACTG 4-1BB Intracellular domain
(nucleic acid sequence)
(SEQ ID NO: 1945)
AAGCGCGGTCGGAAGAAGCTGCTGTACATCTTTAAGCAACCCTTCATGAG

GCCTGTGCAGACTACTCAAGAGGAGGACGGCTGTTCATGCCGGTTCCCAG

AGGAGGAGGAAGGCGGCTGCGAACTG

CD28 Intracellular domain
(amino acid sequence) (SEQ ID NO: 1927)
(SEQ ID NO: 1927)
RSKRSRLLHSDYMNMTPRRPGPTRKHYQPYAPPRDFAAYRS CD28 Intracellular domain
(nucleotide sequence) (SEQ ID NO: 1928)
(SEQ ID NO: 1928)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC

ICOS Intracellular domain
(amino acid sequence) (SEQ ID NO: 1929)
(SEQ ID NO: 1929)
T K K K Y S S S V H D P N G E Y M F M R A V N T A

K K S R L T D V T L

ICOS Intracellular domain
(nucleotide sequence) (SEQ ID NO: 1930)
(SEQ ID NO: 1930)
ACAAAAAAGAAGTATTCATCCAGTGTGCACGACCCTAACGGTGAATACAT

GTTCATGAGAGCAGTGAACACAGCCAAAAAATCCAGACTCACAGATGTGA

CCCTA

CD3 zeta domain (amino acid sequence)
(SEQ ID NO: 1931)
RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence)
(SEQ ID NO: 1932)
AGAGTGAAGTTCAGCAGGAGCGCAGACGCCCCCGCGTACAAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

CD3 zeta (nucleic acid sequence)
(SEQ ID NO: 1946)
CGCGTGAAATTCAGCCGCAGCGCAGATGCTCCAGCCTACAAGCAGGGGCA

GAACCAGCTCTACAACGAACTCAATCTTGGTCGGAGAGAGGAGTACGACG

TGCTGGACAAGCGGAGAGGACGGGACCCAGAAATGGGCGGGAAGCCGCGC

AGAAAGAATCCCCAAGAGGGCCTGTACAACGAGCTCCAAAAGGATAAGAT

GGCAGAAGCCTATAGCGAGATTGGTATGAAAGGGGAACGCAGAAGAGGCA

AAGGCCACGACGGACTGTACCAGGGACTCAGCACCGCCACCAAGGACACC

TATGACGCTCTTCACATGCAGGCCCTGCCGCCTCGG

CD3 zeta domain (amino acid sequence;
NCBI Reference NM_000734.3)
(SEQ ID NO: 1933)
RVKFSRSADAPAYQQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR

CD3 zeta (nucleic acid sequence; NCBI Reference
Sequence NM_000734.3);
(SEQ ID NO: 1934)
AGAGTGAAGTTCAGCAGGAGCGCAGACGCCCCCGCGTACCAGCAGGGCCA

GAACCAGCTCTATAACGAGCTCAATCTAGGACGAAGAGAGGAGTACGATG

TTTTGGACAAGAGACGTGGCCGGGACCCTGAGATGGGGGGAAAGCCGAGA

AGGAAGAACCCTCAGGAAGGCCTGTACAATGAACTGCAGAAAGATAAGAT

GGCGGAGGCCTACAGTGAGATTGGGATGAAAGGCGAGCGCCGGAGGGGCA

AGGGGCACGATGGCCTTTACCAGGGTCTCAGTACAGCCACCAAGGACACC

TACGACGCCCTTCACATGCAGGCCCTGCCCCCTCGC

IgG4 Hinge (amino acid sequence)
(SEQ ID NO: 1935)
ESKYGPPCPPCPAPEFLGGPSVFLFPPKPKDTLMISRTPEVTCVVVDVS

QEDPEVQFNWYVDGVEVHNAKTKPREEQFNSTYRVVSVLTVLHQDWLNGK

EYKCKVSNKGLPSSIEKTISKAKGQPREPQVYTLPPSQEEMTKNQVSLTC

LVKGFYPSDIAVEWESNGQPENNYKTTPPVLDSDGSFFLYSRLTVDKSRW

QEGNVFSCSVMHEALHNHYTQKSLSLSLGKM

IgG4 Hinge (nucleotide sequence)
(SEQ ID NO: 1936)
GAGAGCAAGTACGGCCCTCCCTGCCCCCCTTGCCCTGCCCCCGAG

TTCCTGGGCGGACCCAGCGTGTTCCTGTTCCCCCCCAAGCCCAAGGACAC

CCTGATGATCAGCCGGACCCCCGAGGTGACCTGTGTGGTGGTGGACGTGT

CCCAGGAGGACCCCGAGGTCCAGTTCAACTGGTACGTGGACGGCGTGGAG

GTGCACAACGCCAAGACCAAGCCCCGGGAGGAGCAGTTCAATAGCACCTA

CCGGGTGGTGTCCGTGCTGACCGTGCTGCACCAGGACTGGCTGAACGGCA

AGGAATACAAGTGTAAGGTGTCCAACAAGGGCCTGCCCAGCAGCATCGAG

AAAACCATCAGCAAGGCCAAGGGCCAGCCTCGGGAGCCCCAGGTGTACAC

CCTGCCCCCTAGCCAAGAGGAGATGACCAAGAACCAGGTGTCCCTGACCT

GCCTGGTGAAGGGCTTCTACCCCAGCGACATCGCCGTGGAGTGGGAGAGC

AACGGCCAGCCCGAGAACAACTACAAGACCACCCCCCCTGTGCTGGACAG

CGACGGCAGCTTCTTCCTGTACAGCCGGCTGACCGTGGACAAGAGCCGGT

GGCAGGAGGGCAACGTCTTTAGCTGCTCCGTGATGCACGAGGCCCTGCAC

AACCACTACACCCAGAAGAGCCTGAGCCTGTCCCTGGGCAAGATG

Additional CAR Molecules

In an embodiment, the CAR molecule comprises a mesothelin CAR described herein, e.g., a mesothelin CAR described in WO 2015/090230, incorporated herein by reference. In embodiments, the mesothelin CAR comprises an amino acid, or has a nucleotide sequence shown in WO 2015/090230 incorporated herein by reference, or a sequence substantially identical to any of the aforesaid sequences (e.g., at least 85%, 90%, 95% or more identical to any of the aforesaid mesothelin CAR sequences). In one embodiment, the CAR molecule comprises a mesothelin CAR, or an antigen binding domain according to Tables 2-3 of WO 2015/090230, incorporated herein by reference, or a sequence substantially identical thereto (e.g., at least 85%, 90%, 95% or more identical thereto). The amino acid and nucleotide sequences encoding the mesothelin CAR molecules and antigen binding domains (e.g., including one, two, three VH CDRs; and one, two, three VL CDRs according to Kabat or Chothia), are specified in WO 2015/090230.

In an embodiment, the CAR molecule comprises a CLL1 CAR described herein, e.g., a CLL1 CAR described in US2016/0051651A1, incorporated herein by reference. In embodiments, the CLL1 CAR comprises an amino acid, or has a nucleotide sequence shown in US2016/0051651A1, incorporated herein by reference, or a sequence substantially identical to any of the aforesaid sequences (e.g., at least 85%, 90%, 95% or more identical to any of the aforesaid CLL1 CAR sequences).

In other embodiments, the CLL1 CAR includes a CAR molecule, or an antigen binding domain according to Table 2 of WO2016/014535, incorporated herein by reference, or a sequence substantially identical to any of the aforesaid sequences (e.g., at least 85%, 90%, 95% or more identical to any of the aforesaid CLL1 CAR sequences). The amino acid and nucleotide sequences encoding the CLL-1 CAR molecules and antigen binding domains (e.g., including one, two, three VH CDRs; and one, two, three VL CDRs according to Kabat or Chothia), are specified in WO2016/014535.

In an embodiment, the CAR molecule comprises a CD33 CAR described herein, e.g., a CD33 CAR described in US2016/0096892A1, incorporated herein by reference. In embodiments, the CD33 CAR comprises an amino acid, or has a nucleotide sequence shown in US2016/0096892A1, incorporated herein by reference, or a sequence substantially identical to any of the aforesaid sequences (e.g., at least 85%, 90%, 95% or more identical to any of the aforesaid CD33 CAR sequences). In other embodiments, the CD33 CAR CAR or antigen binding domain thereof can include a CAR molecule (e.g., any of CAR33-1 to CAR-33-9), or an antigen binding domain according to Table 2 or 9 of WO2016/014576, incorporated herein by reference, or a sequence substantially identical to any of the aforesaid sequences (e.g., at least 85%, 90%, 95% or more identical to any of the aforesaid CD33 CAR sequences). The amino acid and nucleotide sequences encoding the CD33 CAR molecules and antigen binding domains (e.g., including one, two, three VH CDRs; and one, two, three VL CDRs according to Kabat or Chothia), are specified in WO2016/014576.

In embodiments, the CAR molecule comprises a CD123 CAR described herein, e.g., a CD123 CAR described in US2014/0322212A1 or US2016/0068601A1, both incorporated herein by reference. In embodiments, the CD123 CAR comprises an amino acid, or has a nucleotide sequence shown in US2014/0322212A1 or US2016/0068601A1, both incorporated herein by reference, or a sequence substantially identical to any of the aforesaid sequences (e.g., at least 85%, 90%, 95% or more identical to any of the aforesaid CD123 CAR sequences). In one embodiment, the CAR molecule comprises a CD123 CAR (e.g., any of the CAR1-CAR8), or an antigen binding domain according to Tables 1-2 of WO 2014/130635, incorporated herein by reference, or a sequence substantially identical thereto (e.g., at least 85%, 90%, 95% or more identical to any of the aforesaid CD123 CAR sequences). The amino acid and nucleotide sequences encoding the CD123 CAR molecules and antigen binding domains (e.g., including one, two, three VH CDRs; and one, two, three VL CDRs according to Kabat or Chothia), are specified in WO 2014/130635.

In other embodiments, the CAR molecule comprises a CD123 CAR comprises a CAR molecule (e.g., any of the CAR123-1 to CAR123-4 and hzCAR123-1 to hzCAR123-32), or an antigen binding domain according to Tables 2, 6, and 9 of WO2016/028896, incorporated herein by reference, or a sequence substantially identical thereto (e.g., at least 85%, 90%, 95% or more identical to any of the aforesaid CD123 CAR sequences). The amino acid and nucleotide sequences encoding the CD123 CAR molecules and antigen binding domains (e.g., including one, two, three VH CDRs; and one, two, three VL CDRs according to Kabat or Chothia), are specified in WO2016/028896.

In an embodiment, the CAR molecule comprises an EGFRvIII CAR molecule described herein, e.g., an EGFRvIII CAR described US2014/0322275A1, incorporated herein by reference. In embodiments, the EGFRvIII CAR comprises an amino acid, or has a nucleotide sequence shown in US2014/0322275A1, incorporated herein by reference, or a sequence substantially identical to any of the aforesaid sequences (e.g., at least 85%, 90%, 95% or more identical to any of the aforesaid EGFRvIII CAR sequences). In one embodiment, the CAR molecule comprises an EGFRvIII CAR, or an antigen binding domain according to Table 2 or SEQ ID NO:11 of WO 2014/130657, incorporated herein by reference, or a sequence substantially identical thereto (e.g., at least 85%, 90%, 95% or more identical thereto). The amino acid and nucleotide sequences encoding the EGFRvIII CAR molecules and antigen binding domains (e.g., including one, two, three VH CDRs; and one, two, three VL CDRs according to Kabat or Chothia), are specified in WO 2014/130657.

In other embodiments, the CAR molecule comprises an a GFR ALPHA-4 CAR, e.g., can include a CAR molecule, or an antigen binding domain according to Table 2 of WO2016/025880, incorporated herein by reference, or a sequence substantially identical to any of the aforesaid sequences (e.g., at least 85%, 90%, 95% or more identical to any of the aforesaid GFR ALPHA-4 sequences). The amino acid and nucleotide sequences encoding the GFR ALPHA-4 CAR molecules and antigen binding domains (e.g., including one, two, three VH CDRs; and one, two, three VL CDRs according to Kabat or Chothia), are specified in WO2016/025880.

In other embodiments, the CAR molecule comprises an axicabtagene ciloleucel molecule, or one or more sequences of an axicabtagene ciloleucel molecule (Table 13). In one embodiment, the CAR molecule comprises a VL that is at least 85%, 90%, 95%, 98%, 99%, or 100% identical to SEQ ID NO: 409. In one embodiment, the CAR molecule comprises a VH that is at least 85%, 90%, 95%, 98%, 99%, or 100% identical to SEQ ID NO: 410. In one embodiment, the CAR molecule comprises an scFv that is at least 85%, 90%, 95%, 98%, 99%, or 100% identical to SEQ ID NO: 411. In one embodiment, the CAR molecule comprises a sequence at least 85%, 90%, 95%, 98%, 99%, or 100% identical to SEQ ID NO: 412. In one embodiment, the CAR molecule comprises a sequence at least 85%, 90%, 95%, 98%, 99%, or 100% identical to SEQ ID NO: 413 (mut 2). In one embodiment, the CAR molecule comprises a sequence at least 85%, 90%, 95%, 98%, 99%, or 100% identical to SEQ ID NO: 414 (mut 3).

TABLE 13

Axicabtagene ciloleucel sequences

| SEQ ID NO | Domain | Sequence |
|---|---|---|
| 409 | VL | DIQMTQTTSSLSASLGDRVTISCRASQDISKYLNWYQQ KPDGTVKLLIYHTSRLHSGVPSRFSGSGSGTDYSLTISNLEQEDIATYF CQQGNTLPYTFGGGTKLEIT |
| 410 | VH | EVKLQESGPGLVAPSQSLSVTCTVSGVSLPDYG VSWIRQPPRKGLEWLGVIWGSETTYYNSALKSRLTIIKDNSKSQVFLKM NSLQTDDTAIYYCAKHYYYGGSYAMDYWGQGTSVTVSS |
| 411 | ScFv | DIQMTQTTSSLSASLGDRVTISCRASQDISKYLNWYQQ KPDGTVKLLIYHTSRLHSGVPSRFSGSGSGTDYSLTISNLEQEDIATYF CQQGNTLPYTFGGGTKLEITGSTSGSGKPGSGEGSTKGEVKLQESGPGLVAPS QSLSVTC TVSGVSLPDYGVSWIRQPPRKGLEWLGVIWGSETTYYNSALKSRLTIIKDNSK SQVFLKM NSLQTDDTAIYYCAKHYYYGGSYAMDYWGQGTSVTVSS |

TABLE 13-continued

Axicabtagene ciloleucel sequences

| SEQ ID NO | Domain | Sequence |
|---|---|---|
| 412 | Full (1) | MLLLVTSLLLCELPHPAFLLIPDIQMTQTTSSLSASLGDRVTISCRASQDISKYLNWYQQKPDGTVK<br>LLIYHTSRLHSGVPSRFSGSGSGTDYSLTISNLEQEDIATYFCQQGNTLPYTFGGGTKLEITGSTSGS<br>GKPGSGEGSTKGEVKLQESGPGLVAPSQSLSVTCTVSGVSLPDYGVSWIRQPPRKGLEWLGVIW<br>GSETTYYNSALKSRLTIIKDNSKSQVFLKMNSLQTDDTAIYYCAKHYYYGGSYAMDYWGQGTSVT<br>VSSAAAIEVMYPPPYLDNEKSNGTIIHVKGKHLCPSPLFPGPSKPFWVLVVVGGVLACYSLLVTVA<br>FIIFWVRSKRSRLLHSDYMFMTPRRPGPTRKHYQPYAPPRDFAAYRSRVKFSRSADAPAYQQGQ<br>NQLYNELNLGRREEYDVLDKRRGRDPEMGGKPRRKNPQEGLYNELQKDKMAEAY<br>SEIGMKGERRRGKGHDGLYQGLSTATKDTYDALHMQALPPR |
| 413 | Full (2) | MLLLVTSLL LCELPHPAFL LIPDIQMTQT TSSLSASLGD RVTISCRASQ DISKYLNWYQ<br>QKPDGTVKLL IYHTSRLHSG<br>VPSRFSGSGS GTDYSLTISN LEQEDIATYF CQQGNTLPYT FGGGTKLEIT GSTSGSGKPG<br>SGEGSTKGEV KLQESGPGLV<br>APSQSLSVTC TVSGVSLPDY GVSWIRQPPR KGLEWLGVIW GSETTYYNSA LKSRLTIIKD<br>NSKSQVFLKM NSLQTDDTAI<br>YYCAKHYYYG GSYAMDYWGQ GTSVTVSSAA AIEVMYPPPY LDNEKSNGTI IHVKGKHLCP<br>SPLFPGPSKP FWVLVVVGGV<br>LACYSLLVTV AFIIFWVRSK RSRLLHSDFM NMTPRRPGPT RKHYQPYAPP RDFAAYRSRV<br>KFSRSADAPA YQQGQNQLYN<br>ELNLGRREEY DVLDKRRGRD PEMGGKPRRK NPQEGLYNEL QKDKMAEAYS EIGMKGERRR<br>GKGHDGLYQG LSTATKDTYD<br>ALHMQALPPR |
| 414 | Full (3) | MLLLVTSLLL CELPHPAFLL IPDIQMTQTT SSLSASLGDR VTISCRASQD<br>ISKYLNWYQQ KPDGTVKLLI YHTSRLHSGV<br>PSRFSGSGSG TDYSLTISNL EQEDIATYFC QQGNTLPYTF GGGTKLEITG<br>STSGSGKPGS GEGSTKGEVK LQESGPGLVA<br>PSQSLSVTCT VSGVSLPDYG VSWIRQPPRK GLEWLGVIWG SETTYYNSAL<br>KSRLTIIKDN SKSQVFLKMN SLQTDDTAIY<br>YCAKHYYYGG SYAMDYWGQG TSVTVSSAAA IEVMYPPPYL DNEKSNGTII<br>HVKGKHLCPS PLFPGPSKPF WVLVVVGGVL<br>ACYSLLVTVA FIIFWVRSKR SRLLHSDFMF MTPRRPGPTR KHYQPYAPPR<br>DFAAYRSRVK FSRSADAPAY QQGQNQLYNE<br>LNLGRREEYD VLDKRRGRDP EMGGKPRRKN PQEGLYNELQ<br>KDKMAEAYSE IGMKGERRRG KGHDGLYQGL STATKDTYDA<br>LHMQALPPR |

In other embodiments, the CAR molecule comprises one or more sequences selected from Table 14. In one embodiment, the CAR molecule comprises a VL that is at least 85%, 90%, 95%, 98%, 99%, or 100% identical to SEQ ID NO: 415. In one embodiment, the CAR molecule comprises a VH that is at least 85%, 90%, 95%, 98%, 99%, or 100% identical to SEQ ID NO: 416. In one embodiment, the CAR molecule comprises an ScFv that is at least 85%, 90%, 95%, 98%, 99%, or 100% identical to SEQ ID NO: 417. In one embodiment, the CAR molecule comprises a sequence at least 85%, 90%, 95% or more identical to SEQ ID NO: 418. In one embodiment, the CAR molecule comprises a sequence at least 85%, 90%, 95%, 98%, 99%, or 100% identical to SEQ ID NO: 419. In one embodiment, the CAR molecule comprises a sequence at least 85%, 90%, 95%, 98%, 99%, or 100% identical to SEQ ID NO: 420.

TABLE 14

| SEQ ID NO | Domain | Sequence |
|---|---|---|
| 415 | VL | ELVLTQSPKFMSTSVGDRVSVTCKASQNVGTNVAWYQQKPGQSPKPLIYSATY<br>RNSGVPDRFTGSGSGTDFTLTITNVQSKDLADYFCQYNRYPYTSFFFTKLEIKRRS |
| 416 | VH | QVQLLESGAELVRPGSSVKISCKASGYAFSSYWMNWVKQRPGQGLEWIGQIYP<br>GDGDTNYNGKFKGQATLTADKSSSTAYMQLSGLTSEDSAVYSCARKTISSVVDF<br>YFDYWGQGTTVT |
| 417 | ScFv | QVQLLESGAELVRPGSSVKISCKASGYAFSSYWMNWVKQRPGQGLEWIGQIYP<br>GDGDTNYNGKFKGQATLTADKSSSTAYMQLSGLTSEDSAVYSCARKTISSVVDF<br>YFDYWGQGTTVTGGGSGGGSGGGSGGGSELVLTQSPKFMSTSVGDRVSVTCKA<br>SQNVGTNVAWYQQKPGQSPKPLIYSATYRNSGVPDRFTGSGSGTDFTLTITNVQ<br>SKDLADYFCQYNRYPYTSFFFTKLEIKRRS |
| 418 | Full (1) | QVQLLESGAELVRPGSSVKISCKASGYAFSSYWMNWVKQRPGQGLEWIGQIYP<br>GDGDTNYNGKFKGQATLTADKSSSTAYMQLSGLTSEDSAVYSCARKTISSVVDF<br>YFDYWGQGTTVTGGGSGGGSGGGSGGGSELVLTQSPKFMSTSVGDRVSVTCKA<br>SQNVGTNVAWYQQKPGQSPKPLIYSATYRNSGVPDRFTGSGSGTDFTLTITNVQ<br>SKDLADYFCQYNRYPYTSFFFTKLEIKRRSKIEVMYPPPYLDNEKSNGTIIHVKG<br>KHLCPSPLFPGPSKPFWVLVVVGGVLACYSLLVTVAFIIFWV<br>RSKRSRLLHSDYMFMTPRRPGPTRKHYQPYAPPRDFAAYRS |

TABLE 14-continued

| SEQ ID NO | Domain | Sequence |
|---|---|---|
| | | RVKFSRSADAPAYQQGQNQLYNELNLGRREEYDVLDKRRGRDPEMGGKPRRK NPQEGLYNELQKDKMAEAYSEIGMKGERRRGKGHDGLYQGLSTATKDTYDAL HMQALPPR |
| 419 | Full (2) | QVQLLESGAELVRPGSSVKISCKASGYAFSSYWMNWVKQRPGQGLEWIGQIYP GDGDTNYNGKFKGQATLTADKSSSTAYMQLSGLTSEDSAVYSCARKTISSVVDF YFDYWGQGTTVTGGGSGGGSGGGSGGGSELVLTQSPKFMSTSVGDRVSVTCKA SQNVGTNVAWYQQKPGQSPKPLIYSATYRNSGVPDRFTGSGSGTDFTLTITNVQ SKDLADYFCQYNRYPYTSFFFTKLEIKRRSKIEVMYPPPYLDNEKSNGTIIHVKG KHLCPSPLFPGPSKPFWVLVVVGGVLACYSLLVTVAFIIFWV RSKRSRLLHSDFMNMTPRRPGPTRKHYQPYAPPRDFAAYRS RVKFSRSADAPAYQQGQNQLYNELNLGRREEYDVLDKRRGRDPEMGGKPRRK NPQEGLYNELQKDKMAEAYSEIGMKGERRRGKGHDGLYQGLSTATKDTYDAL HMQALPPR |
| 420 | Full (3) | QVQLLESGAELVRPGSSVKISCKASGYAFSSYWMNWVKQRPGQGLEWIGQIYP GDGDTNYNGKFKGQATLTADKSSSTAYMQLSGLTSEDSAVYSCARKTISSVVDF YFDYWGQGTTVTGGGSGGGSGGGSGGGSELVLTQSPKFMSTSVGDRVSVTCKA SQNVGTNVAWYQQKPGQSPKPLIYSATYRNSGVPDRFTGSGSGTDFTLTITNVQ SKDLADYFCQYNRYPYTSFFFTKLEIKRRSKIEVMYPPPYLDNEKSNGTIIHVKG KHLCPSPLFPGPSKPFWVLVVVGGVLACYSLLVTVAFIIFWV RSKRSRLLHSDFMFMTPRRPGPTRKHYQPYAPPRDFAAYRS RVKFSRSADAPAYQQGQNQLYNELNLGRREEYDVLDKRRGRDPEMGGKPRRK NPQEGLYNELQKDKMAEAYSEIGMKGERRRGKGHDGLYQGLSTATKDTYDAL HMQALPPR |

In other embodiments, the CAR molecule comprises one or more sequences selected from Table 15. In one embodiment, the CAR molecule comprises a VL that is at least 85%, 90%, 95%, 98%, 99%, or 100% identical to SEQ ID NO: 421. In one embodiment, the CAR molecule comprises a VH that is at least 85%, 90%, 95%, 98%, 99%, or 100% identical to SEQ ID NO: 422. In one embodiment, the CAR molecule comprises an ScFv that is at least 85%, 90%, 95%, 98%, 99%, or 100% identical to SEQ ID NO: 423.

TABLE 15

| SEQ ID NO | Domain | Sequence |
|---|---|---|
| 421 | VL | DIQMTQTT SSLSASLGDR VTISCRASQD ISKY LNWYQQKPDGTVKLLI YHTSRLHSGV PSRFSGSGSG TDYSLTISNL EQEDIATYFC QQGNTLPYTF GGGTKLEIT |
| 422 | VH | EVK LQESGPGLVA PSQSLSVTCT VSGVSLPDYG VSWIRQPPRK GLEWLGVIWG SETTYYNSAL KSRLTIIKDN SKSQVFLKMN SLQTDDTAIY YCAKHYYYGG SYAMDYWGQG TSVTVSSE |
| 423 | ScFv | DIQMTQTT SSLSASLGDR VTISCRASQD ISKYLN WYQQKPDGTVKLLI YHTSRLHSGV PSRFSGSGSG TDYSLTISNL EQEDIATYFC QQGNTLPYTF GGGTKLEITG STSGSGKPGS GEGSTKGEVK LQESGPGLVA PSQSLSVTCT VSGVSLPDYG VSWIRQPPRK GLEWLGVIWG SETTYYNSAL KSRLTIIKDN SKSQVFLKMN SLQTDDTAIY YCAKHYYYGG SYAMDYWGQG TSVTVSSE |

In other embodiments, the CAR molecule comprises one or more sequences selected from Table 16. In one embodiment, the CAR molecule comprises a VL that is at least 85%, 90%, 95%, 98%, 99%, or 100% identical to SEQ ID NO: 424. In one embodiment, the CAR molecule comprises a VH that is at least 85%, 90%, 95%, 98%, 99%, or 100% identical to SEQ ID NO: 425. In one embodiment, the CAR molecule comprises an ScFv that is at least 85%, 90%, 95%, 98%, 99%, or 100% identical to SEQ ID NO: 426.

TABLE 16

| SEQ ID NO | Domain | Sequence |
|---|---|---|
| 424 | VL | DIVLTQSPPSLAMSLGKRATISCRASESVTILGSHL IHWYQQKPGQPPTLLIQLASNVQTGVPARFSGS GSRTDFTLTIDPVEEDDVAVYYCLQSRTI PRTFGGGTKLEIK |
| 425 | VH | QIQLVQSGPELKKPGETVKISCKASGYTFTDYSINW VKRAPGKGLKWMGWINTETREPAYAYDFRGRF AFSLETSASTAYLQINNLKYEDTATYFCALDYSY AMDYWGQGTSVTVSS |
| 426 | ScFv | DIVLTQSPPSLAMSLGKRATISCRASESVTILGS HLIHWYQQKPGQPPTLLIQLASNVQTGVPARFS GSGSRTDFTLTIDPVEEDDVAVYYCLQSRTIRP TFGGGTKLEIKGSTSGSGKPGSGEGSTKGQIQ LVQSGPELKKPGETVKISCKASGYTFTDYSINW VKRAPGKGLKWMGWINTETREPAYAYDFRGR FAFSLETSASTAYLQINNLKYEDTATYFCALDY SYAMDYWGQGTSVTVSS |

RNA Transfection

Disclosed herein are methods for producing an in vitro transcribed RNA CAR. The present invention also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO:32). RNA so produced can efficiently transfect different kinds of cells. In one aspect, the template includes sequences for the CAR.

In one aspect, a CAR of the present invention is encoded by a messenger RNA (mRNA). In one aspect, the mRNA encoding a CAR described herein is introduced into an immune effector cell, e.g., a T cell or a NK cell, for production of a CAR-expressing cell, e.g., a CART cell or a CAR NK cell.

In one embodiment, the in vitro transcribed RNA CAR can be introduced to a cell as a form of transient transfection.

The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired temple for in vitro transcription is a CAR described herein. For example, the template for the RNA CAR comprises an extracellular region comprising a single chain variable domain of an antibody to a tumor associated antigen described herein; a hinge region (e.g., a hinge region described herein), a transmembrane domain (e.g., a transmembrane domain described herein such as a transmembrane domain of CD8a); and a cytoplasmic region that includes an intracellular signaling domain, e.g., an intracellular signaling domain described herein, e.g., comprising the signaling domain of CD3-zeta and the signaling domain of 4-1BB, or a functional variant thereof.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 35) (size can be 50-5000 T (SEQ ID NO: 36)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 37).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 38) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Nucleic Acid Constructs Encoding a CAR

The present invention also provides nucleic acid molecules encoding one or more CAR constructs described herein. In one aspect, the nucleic acid molecule is provided as a messenger RNA transcript. In one aspect, the nucleic acid molecule is provided as a DNA construct.

Accordingly, in one aspect, the invention pertains to a nucleic acid molecule encoding a chimeric antigen receptor (CAR), wherein the CAR comprises an antigen binding domain that binds to a tumor antigen described herein, a transmembrane domain (e.g., a transmembrane domain described herein), and an intracellular signaling domain (e.g., an intracellular signaling domain described herein) comprising a stimulatory domain, e.g., a costimulatory signaling domain (e.g., a costimulatory signaling domain described herein) and/or a primary signaling domain (e.g., a primary signaling domain described herein, e.g., a zeta chain described herein). In one embodiment, the transmembrane domain is transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, or a functional variant thereof.

In one embodiment, the transmembrane domain comprises a sequence of SEQ ID NO: 12, or a sequence with 95-99% identity thereof. In one embodiment, the antigen binding domain is connected to the transmembrane domain by a hinge region, e.g., a hinge described herein. In one embodiment, the hinge region comprises SEQ ID NO: 403, or SEQ ID NO: 405, or SEQ ID NO: 407, or a sequence with 95-99% identity thereof. In one embodiment, the isolated nucleic acid molecule further comprises a sequence encoding a costimulatory domain. In one embodiment, the costimulatory domain is a functional signaling domain of a protein selected from the group consisting of OX40, CD27, CD28, CD5, ICAM-1, LFA-1 (CD11a/CD18), ICOS (CD278), and 4-1BB (CD137). Further examples of such costimulatory molecules include CD5, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, and PAG/Cbp, or a functional variant thereof. In one embodiment, the costimulatory domain comprises a sequence of any one of SEQ ID NOs:1-5, or a sequence with 95-99% identity thereof. In one embodiment, the intracellular signaling domain comprises a functional signaling domain of CD28 and a functional signaling domain of CD3 zeta, or a functional variant thereof. In one embodiment, the intracellular signaling domain comprises the sequence of any one of SEQ ID NOs: 1-5, or a sequence with 95-99% identity thereof, and the sequence of SEQ ID NO: 18 or SEQ ID NO:20, or a sequence with 95-99% identity thereof, wherein the sequences comprising the intracellular signaling domain are expressed in the same frame and as a single polypeptide chain.

In another aspect, the invention pertains to an isolated nucleic acid molecule encoding a CAR construct comprising a leader sequence of SEQ ID NO: 401, a scFv domain as described herein, a hinge region of SEQ ID NO: 403, SEQ ID NO: 405, or SEQ ID NO: 407 (or a sequence with 95-99% identity thereof), a transmembrane domain having a sequence of SEQ ID NO: 12 (or a sequence with 95-99% identity thereof), a CD28 costimulatory domain having a sequence selected from SEQ ID NOs:1-5 (or a sequence with 95-99% identity thereof), and a CD3 zeta stimulatory domain having a sequence of SEQ ID NO:18 or SEQ ID NO:20 (or a sequence with 95-99% identity thereof).

In another aspect, the invention pertains to a nucleic acid molecule encoding a chimeric antigen receptor (CAR) molecule that comprises an antigen binding domain, a transmembrane domain, and an intracellular signaling domain comprising a stimulatory domain, and wherein said antigen binding domain binds to a tumor antigen selected from a group consisting of: CD19, CD123, CD22, CD30, CD171, CS-1, CLL-1 (CLECL1), CD33, EGFRvIII, GD2, GD3, BCMA, Tn Ag, PSMA, ROR1, FLT3, FAP, TAG72, CD38, CD44v6, CEA, EPCAM, B7H3, KIT, IL-13Ra2, Mesothelin, IL-11Ra, PSCA, VEGFR2, LewisY, CD24, PDGFR-beta, SSEA-4, CD20, Folate receptor alpha, ERBB2 (Her2/neu), MUC1, EGFR, NCAM, Prostase, PRSS21, PAP, ELF2M, Ephrin B2, IGF-I receptor, CAIX, LMP2, gp100, bcr-abl, tyrosinase, EphA2, Fucosyl GM1, sLe, GM3, TGS5, HMWMAA, o-acetyl-GD2, Folate receptor beta, TEM1/CD248, TEM7R, CLDN6, TSHR, GPRCSD, CXORF61, CD97, CD179a, ALK, Polysialic acid, PLAC1, GloboH, NY-BR-1, UPK2, HAVCR1, ADRB3, PANX3, GPR20, LY6K, OR51E2, TARP, WT1, NY-ESO-1, LAGE-1a, MAGE-A1, legumain, HPV E6,E7, MAGE A1, ETV6-AML, sperm protein 17, XAGE1, Tie 2, MAD-CT-1, MAD-CT-2, Fos-related antigen 1, p53, p53 mutant, prostein, survivin and telomerase, PCTA-1/Galectin 8, MelanA/MART1, Ras mutant, hTERT, sarcoma translocation breakpoints, ML-IAP, ERG (TMPRSS2 ETS fusion gene), NA17, PAX3, Androgen receptor, Cyclin B1, MYCN, RhoC, TRP-2, CYP1B1, BORIS, SART3, PAX5, OY-TES1, LCK, AKAP-4, SSX2, RAGE-1, human telomerase reverse transcriptase, RU1, RU2, intestinal carboxyl esterase, mut hsp70-2, CD79a, CD79b, CD72, LAIR1, FCAR, LILRA2, CD300LF, CLEC12A, BST2, EMR2, LY75, GPC3, FCRL5, and IGLL1.

In one embodiment, the encoded CAR molecule further comprises a sequence encoding a costimulatory domain. In one embodiment, the costimulatory domain is a functional signaling domain of a protein selected from the group consisting of OX40, CD27, CD28, CD5, ICAM-1, LFA-1 (CD11a/CD18) and 4-1BB (CD137), or a functional variant thereof. In one embodiment, the costimulatory domain comprises a sequence selected from SEQ ID NOs:1-5. In one embodiment, the transmembrane domain is a transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In one embodiment, the transmembrane domain comprises a sequence of SEQ ID NO:12. In one embodiment, the intracellular signaling domain comprises a functional signaling domain of CD28 and a functional signaling domain of zeta. In one embodiment, the intracellular signaling domain comprises a sequence selected from SEQ ID NOs: 1-5 and the sequence of SEQ ID NO: 18, wherein the sequences comprising the intracellular signaling domain are expressed in the same frame and as a single polypeptide chain. In one embodiment, the anti-a cancer associated antigen as described herein binding domain is connected to the transmembrane domain by a hinge region. In one embodiment, the hinge region comprises SEQ ID NO: 403. In one embodiment, the hinge region comprises SEQ ID NO: 405 or SEQ ID NO: 407.

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, crisper, CAS9, and zinc finger nucleases. See below June et al. 2009 *Nature Reviews Immunology* 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1α, ubiquitin C, or phosphoglycerokinase (PGK) promoters.

An example of a promoter that is capable of expressing a CAR encoding nucleic acid molecule in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from nucleic acid molecules cloned into a lentiviral vector. See, e.g., Milone et al., Mol. Ther. 17(8): 1453-1464 (2009). In one aspect, the EF1a promoter comprises the sequence provided as SEQ ID NO: 400.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., a T cell or a NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian immune effector cells (e.g., T cells, NK cells). In one aspect, the mammalian T cell is a human T cell. In one aspect, the mammalian NK cell is a human NK cell.

Sources of Cells

Prior to expansion and genetic modification or other modification, a source of cells, e.g., T cells or natural killer (NK) cells, can be obtained from a subject. The term "subject" is intended to include living organisms in which an immune response can be elicited (e.g., mammals). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In certain aspects of the present disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B7-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can isolated by incubation with anti-CD3/anti-CD28 (e.g., 3×28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours, e.g., 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-$^\gamma$, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 10 billion cells/ml, 9 billion/ml, 8 billion/ml, 7 billion/ml, 6 billion/ml, or 5 billion/ml is used. In one aspect, a concentration of 1 billion cells/ml is used. In yet one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5\times10^6$/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diacylglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogeneic CAR

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated.

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not express or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGF beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA in a T cell.

Expression of siRNA and shRNAs in T cells can be achieved using any conventional expression system, e.g., such as a lentiviral expression system.

Exemplary shRNAs that downregulate expression of components of the TCR are described, e.g., in US Publication No.: 2012/0321667. Exemplary siRNA and shRNA that downregulate expression of HLA class I and/or HLA class II genes are described, e.g., in U.S. publication No.: US 2007/0036773.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene.

Naturally-occurring CRISPR/Cas systems are found in approximately 40% of sequenced eubacteria genomes and 90% of sequenced archaea. Grissa et al. (2007) *BMC Bioinformatics* 8: 172. This system is a type of prokaryotic immune system that confers resistance to foreign genetic elements such as plasmids and phages and provides a form of acquired immunity. Barrangou et al. (2007) *Science* 315: 1709-1712; Marragini et al. (2008) *Science* 322: 1843-1845.

The CRISPR/Cas system has been modified for use in gene editing (silencing, enhancing or changing specific genes) in eukaryotes such as mice or primates. Wiedenheft et al. (2012) *Nature* 482: 331-8. This is accomplished by introducing into the eukaryotic cell a plasmid containing a specifically designed CRISPR and one or more appropriate Cas.

The CRISPR sequence, sometimes called a CRISPR locus, comprises alternating repeats and spacers. In a naturally-occurring CRISPR, the spacers usually comprise sequences foreign to the bacterium such as a plasmid or phage sequence; in the TCR and/or HLA CRISPR/Cas system, the spacers are derived from the TCR or HLA gene sequence.

RNA from the CRISPR locus is constitutively expressed and processed by Cas proteins into small RNAs. These comprise a spacer flanked by a repeat sequence. The RNAs guide other Cas proteins to silence exogenous genetic elements at the RNA or DNA level. Horvath et al. (2010) *Science* 327: 167-170; Makarova et al. (2006) *Biology Direct* 1: 7. The spacers thus serve as templates for RNA molecules, analogously to siRNAs. Pennisi (2013) *Science* 341: 833-836.

As these naturally occur in many different types of bacteria, the exact arrangements of the CRISPR and structure, function and number of Cas genes and their product differ somewhat from species to species. Haft et al. (2005) *PLoS Comput. Biol.* 1: e60; Kunin et al. (2007) *Genome Biol.* 8: R61; Mojica et al. (2005) *J. Mol. Evol.* 60: 174-182; Bolotin et al. (2005) *Microbiol.* 151: 2551-2561; Pourcel et al. (2005) *Microbiol.* 151: 653-663; and Stern et al. (2010) *Trends. Genet.* 28: 335-340. For example, the Cse (Cas subtype, *E. coli*) proteins (e.g., CasA) form a functional complex, Cascade, that processes CRISPR RNA transcripts into spacer-repeat units that Cascade retains. Brouns et al. (2008) *Science* 321: 960-964. In other prokaryotes, Cas6 processes the CRISPR transcript. The CRISPR-based phage inactivation in *E. coli* requires Cascade and Cas3, but not Cas1 or Cas2. The Cmr (Cas RAMP module) proteins in *Pyrococcus furiosus* and other prokaryotes form a functional complex with small CRISPR RNAs that recognizes and cleaves complementary target RNAs. A simpler CRISPR system relies on the protein Cas9, which is a nuclease with two active cutting sites, one for each strand of the double helix. Combining Cas9 and modified CRISPR locus RNA can be used in a system for gene editing. Pennisi (2013) *Science* 341: 833-836.

The CRISPR/Cas system can thus be used to edit a TCR and/or HLA gene (adding or deleting a basepair), or introducing a premature stop which thus decreases expression of a TCR and/or HLA. The CRISPR/Cas system can alternatively be used like RNA interference, turning off TCR and/or HLA gene in a reversible fashion. In a mammalian cell, for example, the RNA can guide the Cas protein to a TCR and/or HLA promoter, sterically blocking RNA polymerases.

Artificial CRISPR/Cas systems can be generated which inhibit TCR and/or HLA, using technology known in the art, e.g., that described in U.S. Publication No. 20140068797, and Cong (2013) Science 339: 819-823. Other artificial CRISPR/Cas systems that are known in the art may also be generated which inhibit TCR and/or HLA, e.g., that described in Tsai (2014) Nature Biotechnol., 32:6 569-576, U.S. Pat. Nos. 8,871,445; 8,865,406; 8,795,965; 8,771,945; and 8,697,359.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene.

TALENs are produced artificially by fusing a TAL effector DNA binding domain to a DNA cleavage domain. Transcription activator-like effects (TALEs) can be engineered to bind any desired DNA sequence, including a portion of the HLA or TCR gene. By combining an engineered TALE with a DNA cleavage domain, a restriction enzyme can be produced which is specific to any desired DNA sequence, including a HLA or TCR sequence. These can then be introduced into a cell, wherein they can be used for genome editing. Boch (2011) *Nature Biotech.* 29: 135-6; and Boch et al. (2009) *Science* 326: 1509-12; Moscou et al. (2009) *Science* 326: 3501.

TALEs are proteins secreted by *Xanthomonas* bacteria. The DNA binding domain contains a repeated, highly conserved 33-34 amino acid sequence, with the exception of the 12th and 13th amino acids. These two positions are highly variable, showing a strong correlation with specific nucleotide recognition. They can thus be engineered to bind to a desired DNA sequence.

To produce a TALEN, a TALE protein is fused to a nuclease (N), which is a wild-type or mutated FokI endonuclease. Several mutations to FokI have been made for its use in TALENs; these, for example, improve cleavage specificity or activity. Cermak et al. (2011) *Nucl. Acids Res.* 39: e82; Miller et al. (2011) *Nature Biotech.* 29: 143-8; Hockemeyer et al. (2011) *Nature Biotech.* 29: 731-734; Wood et al. (2011) *Science* 333: 307; Doyon et al. (2010) *Nature Methods* 8: 74-79; Szczepek et al. (2007) *Nature Biotech.* 25: 786-793; and Guo et al. (2010) *J. Mol. Biol.* 200: 96.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity. Miller et al. (2011) *Nature Biotech.* 29: 143-8.

A HLA or TCR TALEN can be used inside a cell to produce a double-stranded break (DSB). A mutation can be introduced at the break site if the repair mechanisms improperly repair the break via non-homologous end joining. For example, improper repair may introduce a frame shift mutation. Alternatively, foreign DNA can be introduced into the cell along with the TALEN; depending on the sequences of the foreign DNA and chromosomal sequence, this process can be used to correct a defect in the HLA or TCR gene or introduce such a defect into a wt HLA or TCR gene, thus decreasing expression of HLA or TCR.

TALENs specific to sequences in HLA or TCR can be constructed using any method known in the art, including various schemes using modular components. Zhang et al. (2011) *Nature Biotech.* 29: 149-53; Geibler et al. (2011) *PLoS ONE* 6: e19509.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene.

Like a TALEN, a ZFN comprises a FokI nuclease domain (or derivative thereof) fused to a DNA-binding domain. In the case of a ZFN, the DNA-binding domain comprises one or more zinc fingers. Carroll et al. (2011) *Genetics Society of America* 188: 773-782; and Kim et al. (1996) *Proc. Natl. Acad. Sci. USA* 93: 1156-1160.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart. Bitinaite et al. (1998) *Proc. Natl. Acad. Sci. USA* 95: 10570-5.

Also like a TALEN, a ZFN can create a double-stranded break in the DNA, which can create a frame-shift mutation if improperly repaired, leading to a decrease in the expression and amount of HLA and/or TCR in a cell. ZFNs can also be used with homologous recombination to mutate in the HLA or TCR gene.

ZFNs specific to sequences in HLA AND/OR TCR can be constructed using any method known in the art. See, e.g., Provasi (2011) Nature Med. 18: 807-815; Torikai (2013) Blood 122: 1341-1349; Cathomen et al. (2008) Mol. Ther. 16: 1200-7; Guo et al. (2010) *J. Mol. Biol.* 400: 96; U.S. Patent Publication 2011/0158957; and U.S. Patent Publication 2012/0060230.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In one aspect, the disclosure features a method of making a population of immune effector cells (e.g., T cells, NK cells). In an embodiment, the method comprises: providing a population of immune effector cells (e.g., T cells or NK cells), contacting the population of immune effector cells with a nucleic acid encoding a CAR; and contacting the population of immune effector cells with a nucleic acid encoding a telomerase subunit, e.g., hTERT, under conditions that allow for CAR and telomerase expression.

In an embodiment, the nucleic acid encoding the telomerase subunit is DNA. In an embodiment, the nucleic acid encoding the telomerase subunit comprises a promoter capable of driving expression of the telomerase subunit.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795) as follows:

```
                                            (SEQ ID NO: 61)
MPRAPRCRAVRSLLRSHYREVLPLATFVRRLGPQGWRLVQRGDPAAFRAL

VAQCLVCVPWDARPPPAAPSFRQVSCLKELVARVLQRLCERGAKNVLAFG

FALLDGARGGPPEAFTTSVRSYLPNTVTDALRGSGAWGLLLRRVGDDVLV

HLLARCALFVLVAPSCAYQVCGPPLYQLGAATQARPPPHASGPRRRLGCE

RAWNHSVREAGVPLGLPAPGARRRGGSASRSLPLPKRPRRGAAPEPERTP

VGQGSWAHPGRTRGPSDRGFCVVSPARPAEEATSLEGALSGTRHSHPSVG

RQHHAGPPSTSRPPRPWDTPCPPVYAETKHFLYSSGDKEQLRPSFLLSSL

RPSLTGARRLVETIFLGSRPWMPGTPRRLPRLPQRYWQMRPLFLELLGNH

AQCPYGVLLKTHCPLRAAVTPAAGVCAREKPQGSVAAPEEEDTDPRRLVQ

LLRQHSSPWQVYGFVRACLRRLVPPGLWGSRHNERRFLRNTKKFISLGKH

AKLSLQELTWKMSVRGCAWLRRSPGVGCVPAAEHRLREEILAKFLHWLMS

VYVVELLRSFFYVTETTFQKNRLFFYRKSVWSKLQSIGIRQHLKRVQLRE

LSEAEVRQHREARPALLTSRLRFIPKPDGLRPIVNMDYVVGARTFRREKR

AERLTSRVKALFSVLNYERARRPGLLGASVLGLDDIHRAWRTFVLRVRAQ

DPPPELYFVKVDVTGAYDTIPQDRLTEVIASIIKPQNTYCVRRYAVVQKA

AHGHVRKAFKSHVSTLTDLQPYMRQFVAHLQETSPLRDAVVIEQSSSLNE

ASSGLFDVFLRFMCHHAVRIRGKSYVQCQGIPQGSILSTLLCSLCYGDME

NKLFAGIRRDGLLLRLVDDFLLVTPHLTHAKTFLRTLVRGVPEYGCVVNL

RKTVVNFPVEDEALGGTAFVQMPAHGLFPWCGLLLDTRTLEVQSDYSSYA

RTSIRASLTFNRGFKAGRNMRRKLFGVLRLKCHSLFLDLQVNSLQTVCTN

IYKILLLQAYRFHACVLQLPFHQQVWKNPTFFLRVISDTASLCYSILKAK

NAGMSLGAKGAAGPLPSEAVQWLCHQAFLLKLTRHRVTYVPLLGSLRTAQ

TQLSRKLPGTTLTALEAAANPALPSDFKTILD
```

In an embodiment, the hTERT has a sequence at least 80%, 85%, 90%, 95%, 96^, 97%, 98%, or 99% identical to the sequence of SEQ ID NO: 61. In an embodiment, the hTERT has a sequence of SEQ ID NO: 61. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

```
                                                    (SEQ ID NO: 62)
  1  caggcagcgt ggtcctgctg cgcacgtggg aagccctggc cccggccacc cccgcgatgc 61  cgcgcgctcc ccgctgccga gccgtgcgct ccctgctgcg cagccactac cgcgaggtgc
```

-continued

```
 121 tgccgctggc cacgttcgtg cggcgcctgg ggcccaggg ctggcggctg gtgcagcgcg
 181 gggaccggc ggcttccgc gcgctggtgg cccagtgcct ggtgtgcgtg ccctgggacg
 241 cacggccgcc ccccgccgcc ccctccttcc gccaggtgtc ctgcctgaag gagctggtgg
 301 cccgagtgct gcagaggctg tgcgagcgcg gcgcgaagaa cgtgctggcc ttcggcttcg
 361 cgctgctgga cggggcccgc gggggccccc ccgaggcctt caccaccagc gtgcgcagct
 421 acctgcccaa cacggtgacc gacgcactgc ggggagcgg ggcgtggggg ctgctgttgc
 481 gccgcgtggg cgacgacgtg ctggttcacc tgctggcacg ctgcgcgctc tttgtgctgg
 541 tggctcccag ctgcgcctac caggtgtgcg ggccgccgct gtaccagctc ggcgctgcca
 601 ctcaggcccg gcccccgcca cacgctagtg gaccccgaag gcgtctggga tgcgaacggg
 661 cctggaacca tagcgtcagg gaggccgggg tccccctggg cctgccagcc ccgggtgcga
 721 ggaggcgcgg gggcagtgcc agccgaagtc tgccgttgcc caagaggccc aggcgtggcg
 781 ctgcccctga gccggagcgg acgcccgttg gcaggggtc ctgggcccac ccgggcagga
 841 cgcgtggacc gagtgaccgt ggtttctgtg tggtgtcacc tgccagaccc gccgaagaag
 901 ccacctcttt ggagggtgcg ctctctggca cgcgccactc ccacccatcc gtgggccgcc
 961 agcaccacgc gggccccca tccacatcgc ggccaccacg tccctgggac acgccttgtc
1021 ccccggtgta cgccgagacc aagcacttcc tctactcctc aggcgacaag gagcagctgc
1081 ggccctcctt cctactcagc tctctgaggc ccagcctgac tggcgctcgg aggctcgtgg
1141 agaccatctt tctgggttcc aggccctgga tgccagggac tccccgcagg ttgccccgcc
1201 tgccccagcg ctactggcaa atgcggcccc tgtttctgga gctgcttggg aaccacgcgc
1261 agtgccccta cggggtgctc ctcaagacgc actgcccgct gcgagctgcg gtcacccag
1321 cagccggtgt ctgtgcccgg gagaagcccc agggctctgt ggcggccccc gaggaggagg
1381 acacagaccc ccgtcgcctg gtgcagctgc tccgccagca cagcagcccc tggcaggtgt
1441 acggcttcgt gcgggcctgc ctgcgccggc tggtgccccc aggcctctgg ggctccaggc
1501 acaacgaacg ccgcttcctc aggaacacca agaagttcat ctccctgggg aagcatgcca
1561 agctctcgct gcaggagctg acgtggaaga tgagcgtgcg gggctgcgct tggctgcgca
1621 ggagcccagg ggttggctgt gttccggccg cagagcaccg tctgcgtgag gagatcctgg
1681 ccaagttcct gcactggctg atgagtgtgt acgtcgtcga gctgctcagg tctttctttt
1741 atgtcacgga gaccacgttt caaaagaaca ggctcttttt ctaccggaag agtgtctgga
1801 gcaagttgca aagcattgga atcagacagc acttgaagag ggtgcagctg cgggagctgt
1861 cggaagcaga ggtcaggcag catcgggaag ccaggcccgc cctgctgacg tccagactcc
1921 gcttcatccc caagcctgac gggctgcggc cgattgtgaa catggactac gtcgtgggag
1981 ccagaacgtt ccgcagagaa aagagggccg agcgtctcac ctcgagggtg aaggcactgt
2041 tcagcgtgct caactacgag cgggcgcggc gccccggcct cctgggcgcc tctgtgctgg
2101 gcctggacga tatccacagg gcctggcgca ccttcgtgct gcgtgtgcgg gcccaggacc
2161 cgccgcctga gctgtacttt gtcaaggtgg atgtgacggg cgcgtacgac accatccccc
2221 aggacaggct cacggaggtc atcgccagca tcatcaaacc ccagaacacg tactgcgtgc
2281 gtcggtatgc cgtggtccag aaggccgccc atgggcacgt ccgcaaggcc ttcaagagcc
2341 acgtctctac cttgacagac ctccagccgt acatgcgaca gttcgtggct cacctgcagg
2401 agaccagccc gctgagggat gccgtcgtca tcgagcagag ctcctccctg aatgaggcca
2461 gcagtggcct cttcgacgtc ttcctacgct tcatgtgcca ccacgccgtg cgcatcaggg
2521 gcaagtccta cgtccagtgc cagggatcc cgcagggctc catcctctcc acgctgctct
```

```
-continued 2581 gcagcctgtg ctacggcgac atggagaaca agctgtttgc ggggattcgg cgggacgggc 2641 tgctcctgcg tttggtggat gatttcttgt tggtgacacc tcacctcacc cacgcgaaaa 2701 ccttcctcag gaccctggtc cgaggtgtcc ctgagtatgg ctgcgtggtg aacttgcgga 2761 agacagtggt gaacttccct gtagaagacg aggccctggg tggcacggct tttgttcaga 2821 tgccggccca cggcctattc ccctggtgcg gcctgctgct ggatacccgg accctggagg 2881 tgcagagcga ctactccagc tatgcccgga cctccatcag agccagtctc accttcaacc 2941 gcggcttcaa ggctgggagg aacatgcgtc gcaaactctt tggggtcttg cggctgaagt 3001 gtcacagcct gtttctggat ttgcaggtga acagcctcca gacggtgtgc accaacatct 3061 acaagatcct cctgctgcag gcgtacaggt ttcacgcatg tgtgctgcag ctcccatttc 3121 atcagcaagt ttggaagaac cccacatttt tcctgcgcgt catctctgac acggcctccc 3181 tctgctactc catcctgaaa gccaagaacg cagggatgtc gctggggcc aagggcgccg 3241 ccggccctct gccctccgag gccgtgcagt ggctgtgcca ccaagcattc ctgctcaagc 3301 tgactcgaca ccgtgtcacc tacgtgccac tcctggggtc actcaggaca gcccagacgc 3361 agctgagtcg gaagctcccg gggacgacgc tgactgccct ggaggccgca gccaacccgg 3421 cactgccctc agacttcaag accatcctgg actgatggcc acccgccac agccaggccg 3481 agagcagaca ccagcagccc tgtcacgccg ggctctacgt cccagggagg gagggcggc 3541 ccacacccag gcccgcaccg ctgggagtct gaggcctgag tgagtgtttg gccgaggcct 3601 gcatgtccgg ctgaaggctg agtgtccggc tgaggcctga gcgagtgtcc agccaagggc 3661 tgagtgtcca gcacacctgc cgtcttcact tccccacagg ctggcgctcg gctccacccc 3721 agggccagct tttcctcacc aggagcccgg cttccactcc ccacatagga atagtccatc 3781 cccagattcg ccattgttca cccctcgccc tgccctcctt tgccttccac ccccaccatc 3841 caggtggaga ccctgagaag gaccctggga gctctgggaa tttggagtga ccaaaggtgt 3901 gccctgtaca caggcgagga ccctgcacct ggatgggggt ccctgtgggt caaattgggg 3961 ggaggtgctg tgggagtaaa atactgaata tatgagtttt tcagttttga aaaaaaaaa 4021 aaaaaaa
```

In an embodiment, the hTERT is encoded by a nucleic acid having a sequence at least 80%, 85%, 90%, 95%, 96, 97%, 98%, or 99% identical to the sequence of SEQ ID NO: 62. In an embodiment, the hTERT is encoded by the nucleic acid of SEQ ID NO: 62.

Activation and Expansion of Immune Effector Cells (e.g., T Cells)

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

As demonstrated by the data disclosed herein, expanding the T cells by the methods disclosed herein can multiply the cells by about 10 fold, 20 fold, 30 fold, 40 fold, 50 fold, 60 fold, 70 fold, 80 fold, 90 fold, 100 fold, 200 fold, 300 fold, 400 fold, 500 fold, 600 fold, 700 fold, 800 fold, 900 fold, 1000 fold, 2000 fold, 3000 fold, 4000 fold, 5000 fold, 6000 fold, 7000 fold, 8000 fold, 9000 fold, 10,000 fold, 100,000 fold, 1,000,000 fold, 10,000,000 fold, or greater, and any and all whole or partial intergers therebetween. In one embodiment, the T cells expand in the range of about 20 fold to about 50 fold.

Generally, a population of immune effector cells e.g., T regulatory cell depleted cells, may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besançon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values therebetween. In one aspect, more anti-CD28 antibody is bound to the particles than anti-CD3 antibody, i.e., the ratio of CD3:CD28 is less than one. In certain aspects, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a CD19 CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a CD19 CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a CD19 CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a CD19 CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, e.g., CAR-expressing cell manufacturing methods, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments a CAR-expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a CAR described herein is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a cars of the present invention are described in further detail below Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of $CAR^+$ T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the $CD4^+$ and/or $CD8^+$ T cell subsets by flow cytometry. See, e.g., Milone et al., Molecular Therapy 17(8): 1453-1464 (2009). Alternatively, a mixture of $CD4^+$ and $CD8^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either a cancer associated antigen as described herein+ K562 cells (K562 expressing a cancer associated antigen as described herein), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. $GFP^+$ T cells are enumerated by flow cytometry using bead-based counting. See, e.g., Milone et al., Molecular Therapy 17(8): 1453-1464 (2009).

Sustained $CAR^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human a cancer associated antigen described herein-specific $CAR^+$ T cells to treat a primary human pre-B ALL in immunodeficient mice can be used. See, e.g., Milone et al., Molecular Therapy 17(8): 1453-1464 (2009). Very briefly, after establishment of ALL, mice are randomized as to treatment groups. Different numbers of a cancer associated antigen-specific CARengineered T cells are coinjected at a 1:1 ratio into NOD-SCID-γ$^{-/-}$ mice bearing B-ALL. The number of copies of a cancer associated antigen-specific CAR vector in spleen DNA from mice is evaluated at various times following T cell injection. Animals are assessed for leukemia at weekly intervals. Peripheral blood a cancer associate antigen as described herein+ B-ALL blast cell counts are measured in mice that are injected with a cancer associated antigen described herein-ζ $CAR^+$ T cells or mock-transduced T cells. Survival curves for the groups are compared using the log-rank test. In addition, absolute peripheral blood $CD4^+$ and $CD8^+$ T cell counts 4 weeks following T cell injection in NOD-SCID-γ$^{-/-}$ mice can also be analyzed. Mice are injected with leukemic cells and 3 weeks later are injected with T cells engineered to express CAR by a bicistronic lentiviral vector that encodes the CAR linked to eGFP. T cells are normalized to 45-50% input $GFP^+$ T cells by mixing with mock-transduced cells prior to injection, and confirmed by flow cytometry. Animals are assessed for leukemia at 1-week intervals. Survival curves for the $CAR^+$ T cell groups are compared using the log-rank test.

Dose dependent CAR treatment response can be evaluated. See, e.g., Milone et al., Molecular Therapy 17(8): 1453-1464 (2009). For example, peripheral blood is obtained 35-70 days after establishing leukemia in mice injected on day 21 with CAR T cells, an equivalent number of mock-transduced T cells, or no T cells. Mice from each group are randomly bled for determination of peripheral blood a cancer associate antigen as described herein+ ALL blast counts and then killed on days 35 and 49. The remaining animals are evaluated on days 57 and 70.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing a cancer associated antigen described herein (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term $CD8^+$ T cell expansion ex vivo. T cells are enumerated in cultures using CountBright™ fluorescent beads (Invitrogen, Carlsbad, Calif.) and flow cytometry as described by the manufacturer. $CAR^+$ T cells are identified by GFP expression using T cells that are engineered with eGFP-2A linked CAR-expressing lentiviral vectors. For CAR+ T cells not expressing GFP, the CAR+ T cells are detected with biotinylated recombinant a cancer associate antigen as described herein protein and a secondary avidin-PE conjugate. CD4+ and $CD8^+$ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, Calif.) according the manufacturer's instructions. Fluorescence is assessed using a FACScalibur flow cytometer, and data is analyzed according to the manufacturer's instructions.

Cytotoxicity can be assessed by a standard 51Cr-release assay. See, e.g., Milone et al., Molecular Therapy 17(8): 1453-1464 (2009). Briefly, target cells (K562 lines and primary pro-B-ALL cells) are loaded with 51Cr (as NaCrO4, New England Nuclear, Boston, Mass.) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, Mass.). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/γc$^{−/−}$ (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR$^+$ T cells in Nalm-6 xenograft model can be measured as the following: NSG mice are injected with Nalm-6 transduced to stably express firefly luciferase, followed by a single tail-vein injection of T cells electroporated with cars of the present invention 7 days later. Animals are imaged at various time points post injection. For example, photon-density heat maps of firefly luciferase positive leukemia in representative mice at day 5 (2 days before treatment) and day 8 (24 hr post CAR$^+$ PBLs) can be generated.

Other assays, including those described in the Example section herein as well as those that are known in the art can also be used to evaluate the CARs described herein.

Therapeutic Application

The modified cells described herein may be included in a composition for therapy. In one aspect, the composition comprises a population of modified T cells comprising a nucleic acid sequence encoding a CAR, wherein the CAR comprises a mutant CD28 costimulatory domain. In another aspect, the composition comprises the modified T cell comprising a nucleic acid sequence encoding a CAR, wherein the CAR comprises a mutant CD28 costimulatory domain that increases anti-tumor effect and T cell persistence. In yet another embodiment, the composition includes a modified T cell comprising a CAR that comprises a costimulatory domain described herein, e.g., that increases anti-tumor effect and T cell persistence. The composition may include a pharmaceutical composition and further include a pharmaceutically acceptable carrier. A therapeutically effective amount of the pharmaceutical composition comprising the modified cells may be administered.

In one aspect, the invention includes a method comprising administering a population of modified T cells to a subject in need thereof to prevent or treat a tumor, wherein the modified T cells comprise a nucleic acid sequence encoding a CAR and a nucleic acid sequence encoding a peptide described herein, e.g., a peptide comprising an amphipathic helix domain and a cluster of basic amino acids, wherein the peptide disrupts PKA and an AKAP association.

In another aspect, the invention includes a method comprising administering a population of modified cells to a subject in need thereof to prevent or treat a tumor that is adverse to the subject, wherein the modified cells comprise a CAR and a peptide described herein, e.g., a peptide that disrupts PKA and an AKAP binding.

In one aspect, the invention provides methods for treating a disease associated with expression of a cancer associated antigen described herein.

In one aspect, the present invention provides methods of treating cancer by providing to the subject in need thereof immune effector cells (e.g., T cells, NK cells) that are engineered to express an XCAR, wherein X represents a tumor antigen as described herein, and wherein the cancer cells express said X tumor antigen.

In one aspect, the present invention provides methods of treating cancer by providing to the subject in need thereof immune effector cells (e.g., T cells, NK cells) that are engineered to express a XCAR described herein, wherein the cancer cells express X. In one embodiment, X is expressed on both normal cells and cancers cells, but is expressed at lower levels on normal cells. In one embodiment, the method further comprises selecting a CAR that binds X with an affinity that allows the XCAR to bind and kill the cancer cells expressing X but less than 30%, 25%, 20%, 15%, 10%, 5% or less of the normal cells expressing X are killed, e.g., as determined by an assay described herein. In one embodiment, the selected CAR has an antigen binding domain that has a binding affinity KD of $10^{−4}$ M to $10^{−8}$ M, e.g., $10^{−5}$ M to $10^{−7}$ M, e.g., $10^{−6}$ M or $10^{−7}$ M, for the target antigen. In one embodiment, the selected antigen binding domain has a binding affinity that is at least five-fold, 10-fold, 20-fold, 30-fold, 50-fold, 100-fold or 1,000-fold less than a reference antibody, e.g., an antibody described herein.

In one embodiment, the present invention provides methods of treating cancer by providing to the subject in need thereof immune effector cells (e.g., T cells, NK cells) that are engineered to express CD19 CAR, wherein the cancer cells express CD19. In one embodiment, the cancer to be treated is ALL (acute lymphoblastic leukemia), CLL (chronic lymphocytic leukemia), DLBCL (diffuse large B-cell lymphoma), MCL (Mantle cell lymphoma, or MM (multiple myeloma).

In one aspect, the present invention provides methods of treating cancer by providing to the subject in need thereof immune effector cells (e.g., T cells, NK cells) that are engineered to express an EGFRvIIICAR, wherein the cancer cells express EGFRvIII. In one embodiment, the cancer to be treated is glioblastoma.

In one aspect, the present invention provides methods of treating cancer by providing to the subject in need thereof immune effector cells (e.g., T cells, NK cells) that are engineered to express a mesothelinCAR, wherein the cancer cells express mesothelin. In one embodiment, the cancer to be treated is mesothelioma, pancreatic cancer, or ovarian cancer.

In one aspect, the present invention provides methods of treating cancer by providing to the subject in need thereof immune effector cells (e.g., T cells, NK cells) that are engineered to express a CD123CAR, wherein the cancer cells express CD123. In one embodiment, the cancer to be treated is AML.

In one aspect, the present invention provides methods of treating cancer by providing to the subject in need thereof immune effector cells (e.g., T cells, NK cells) that are engineered to express a CD22CAR, wherein the cancer cells express CD22. In one embodiment, the cancer to be treated is B cell malignancies.

In one aspect, the present invention provides methods of treating cancer by providing to the subject in need thereof immune effector cells (e.g., T cells, NK cells) that are engineered to express a CS-1CAR, wherein the cancer cells express CS-1. In one embodiment, the cancer to be treated is multiple myeloma.

In one aspect, the present invention provides methods of treating cancer by providing to the subject in need thereof immune effector cells (e.g., T cells, NK cells) that are engineered to express a CLL-1CAR, wherein the cancer cells express CLL-1. In one embodiment, the cancer to be treated is AML.

In one aspect, the present invention provides methods of treating cancer by providing to the subject in need thereof immune effector cells (e.g., T cells, NK cells) that are engineered to express a CD33CAR, wherein the cancer cells express CD33. In one embodiment, the cancer to be treated is AML.

In one aspect, the present invention provides methods of treating cancer by providing to the subject in need thereof immune effector cells (e.g., T cells, NK cells) that are engineered to express a GD2CAR, wherein the cancer cells express GD2. In one embodiment, the cancer to be treated is neuroblastoma.

In one aspect, the present invention provides methods of treating cancer by providing to the subject in need thereof immune effector cells (e.g., T cells, NK cells) that are engineered to express a BCMACAR, wherein the cancer cells express BCMA. In one embodiment, the cancer to be treated is multiple myeloma.

In one aspect, the present invention provides methods of treating cancer by providing to the subject in need thereof immune effector cells (e.g., T cells, NK cells) that are engineered to express a TnCAR, wherein the cancer cells express Tn antigen. In one embodiment, the cancer to be treated is ovarian cancer.

In one aspect, the present invention provides methods of treating cancer by providing to the subject in need thereof immune effector cells (e.g., T cells, NK cells) that are engineered to express a PSMACAR, wherein the cancer cells express PSMA. In one embodiment, the cancer to be treated is prostate cancer.

In one aspect, the present invention provides methods of treating cancer by providing to the subject in need thereof immune effector cells (e.g., T cells, NK cells) that are engineered to express a ROR1CAR, wherein the cancer cells express ROR1. In one embodiment, the cancer to be treated is B cell malignancies.

In one aspect, the present invention provides methods of treating cancer by providing to the subject in need thereof immune effector cells (e.g., T cells, NK cells) that are engineered to express a FLT3 CAR, wherein the cancer cells express FLT3. In one embodiment, the cancer to be treated is AML.

In one aspect, the present invention provides methods of treating cancer by providing to the subject in need thereof immune effector cells (e.g., T cells, NK cells) that are engineered to express a TAG72CAR, wherein the cancer cells express TAG72. In one embodiment, the cancer to be treated is gastrointestinal cancer.

In one aspect, the present invention provides methods of treating cancer by providing to the subject in need thereof immune effector cells (e.g., T cells, NK cells) that are engineered to express a CD38CAR, wherein the cancer cells express CD38. In one embodiment, the cancer to be treated is multiple myeloma.

In one aspect, the present invention provides methods of treating cancer by providing to the subject in need thereof immune effector cells (e.g., T cells, NK cells) that are engineered to express a CD44v6CAR, wherein the cancer cells express CD44v6. In one embodiment, the cancer to be treated is cervical cancer, AML, or MM.

In one aspect, the present invention provides methods of treating cancer by providing to the subject in need thereof immune effector cells (e.g., T cells, NK cells) that are engineered to express a CEACAR, wherein the cancer cells express CEA. In one embodiment, the cancer to be treated is gastrointestinal cancer, or pancreatic cancer.

In one aspect, the present invention provides methods of treating cancer by providing to the subject in need thereof immune effector cells (e.g., T cells, NK cells) that are engineered to express an EPCAMCAR, wherein the cancer cells express EPCAM. In one embodiment, the cancer to be treated is gastrointestinal cancer.

In one aspect, the present invention provides methods of treating cancer by providing to the subject in need thereof immune effector cells (e.g., T cells, NK cells) that are engineered to express a B7H3CAR, wherein the cancer cells express B7H3.

In one aspect, the present invention provides methods of treating cancer by providing to the subject in need thereof immune effector cells (e.g., T cells, NK cells) that are engineered to express a KITCAR, wherein the cancer cells express KIT. In one embodiment, the cancer to be treated is gastrointestinal cancer.

In one aspect, the present invention provides methods of treating cancer by providing to the subject in need thereof immune effector cells (e.g., T cells, NK cells) that are engineered to express an IL-13Ra2CAR, wherein the cancer cells express IL-13Ra2. In one embodiment, the cancer to be treated is glioblastoma.

In one aspect, the present invention provides methods of treating cancer by providing to the subject in need thereof immune effector cells (e.g., T cells, NK cells) that are engineered to express a PRSS21CAR, wherein the cancer cells express PRSS21. In one embodiment, the cancer to be treated is selected from ovarian, pancreatic, lung and breast cancer.

In one aspect, the present invention provides methods of treating cancer by providing to the subject in need thereof immune effector cells (e.g., T cells, NK cells) that are engineered to express a CD30CAR, wherein the cancer cells express CD30. In one embodiment, the cancer to be treated is lymphomas, or leukemias.

In one aspect, the present invention provides methods of treating cancer by providing to the subject in need thereof immune effector cells (e.g., T cells, NK cells) that are engineered to express a GD3CAR, wherein the cancer cells express GD3. In one embodiment, the cancer to be treated is melanoma.

In one aspect, the present invention provides methods of treating cancer by providing to the subject in need thereof immune effector cells (e.g., T cells, NK cells) that are engineered to express a CD171CAR, wherein the cancer cells express CD171. In one embodiment, the cancer to be treated is neuroblastoma, ovarian cancer, melanoma, breast cancer, pancreatic cancer, colon cancers, or NSCLC (non-small cell lung cancer).

In one aspect, the present invention provides methods of treating cancer by providing to the subject in need thereof immune effector cells (e.g., T cells, NK cells) that are engineered to express an IL-11RaCAR, wherein the cancer cells express IL-11Ra. In one embodiment, the cancer to be treated is osteosarcoma.

In one aspect, the present invention provides methods of treating cancer by providing to the subject in need thereof immune effector cells (e.g., T cells, NK cells) that are engineered to express a PSCACAR, wherein the cancer cells express PSCA. In one embodiment, the cancer to be treated is prostate cancer.

In one aspect, the present invention provides methods of treating cancer by providing to the subject in need thereof immune effector cells (e.g., T cells, NK cells) that are engineered to express a VEGFR2CAR, wherein the cancer cells express VEGFR2. In one embodiment, the cancer to be treated is a solid tumor.

In one aspect, the present invention provides methods of treating cancer by providing to the subject in need thereof immune effector cells (e.g., T cells, NK cells) that are engineered to express a LewisYCAR, wherein the cancer cells express LewisY. In one embodiment, the cancer to be treated is ovarian cancer, or AML.

In one aspect, the present invention provides methods of treating cancer by providing to the subject in need thereof immune effector cells (e.g., T cells, NK cells) that are engineered to express a CD24CAR, wherein the cancer cells express CD24. In one embodiment, the cancer to be treated is pancreatic cancer.

In one aspect, the present invention provides methods of treating cancer by providing to the subject in need thereof immune effector cells (e.g., T cells, NK cells) that are engineered to express a PDGFR-betaCAR, wherein the cancer cells express PDGFR-beta. In one embodiment, the cancer to be treated is breast cancer, prostate cancer, GIST (gastrointestinal stromal tumor), CML, DFSP (dermatofibrosarcoma protuberans), or glioma.

In one aspect, the present invention provides methods of treating cancer by providing to the subject in need thereof immune effector cells (e.g., T cells, NK cells) that are engineered to express a SSEA-4CAR, wherein the cancer cells express SSEA-4. In one embodiment, the cancer to be treated is glioblastoma, breast cancer, lung cancer, or stem cell cancer.

In one aspect, the present invention provides methods of treating cancer by providing to the subject in need thereof immune effector cells (e.g., T cells, NK cells) that are engineered to express a CD20CAR, wherein the cancer cells express CD20. In one embodiment, the cancer to be treated is B cell malignancies.

In one aspect, the present invention provides methods of treating cancer by providing to the subject in need thereof immune effector cells (e.g., T cells, NK cells) that are engineered to express a Folate receptor alphaCAR, wherein the cancer cells express folate receptor alpha. In one embodiment, the cancer to be treated is ovarian cancer, NSCLC, endometrial cancer, renal cancer, or other solid tumors.

In one aspect, the present invention provides methods of treating cancer by providing to the subject in need thereof immune effector cells (e.g., T cells, NK cells) that are engineered to express an ERBB2CAR, wherein the cancer cells express ERBB2 (Her2/neu). In one embodiment, the cancer to be treated is breast cancer, gastric cancer, colorectal cancer, lung cancer, or other solid tumors.

In one aspect, the present invention provides methods of treating cancer by providing to the subject in need thereof immune effector cells (e.g., T cells, NK cells) that are engineered to express a MUC1CAR, wherein the cancer cells express MUC1. In one embodiment, the cancer to be treated is breast cancer, lung cancer, or other solid tumors.

In one aspect, the present invention provides methods of treating cancer by providing to the subject in need thereof immune effector cells (e.g., T cells, NK cells) that are engineered to express an EGFRCAR, wherein the cancer cells express EGFR. In one embodiment, the cancer to be treated is glioblastoma, SCLC (small cell lung cancer), SCCHN (squamous cell carcinoma of the head and neck), NSCLC, or other solid tumors.

In one aspect, the present invention provides methods of treating cancer by providing to the subject in need thereof immune effector cells (e.g., T cells, NK cells) that are engineered to express a NCAMCAR, wherein the cancer cells express NCAM. In one embodiment, the cancer to be treated is neuroblastoma, or other solid tumors.

In one aspect, the present invention provides methods of treating cancer by providing to the subject in need thereof immune effector cells (e.g., T cells, NK cells) that are engineered to express a CAIXCAR, wherein the cancer cells express CAIX. In one embodiment, the cancer to be treated is renal cancer, CRC, cervical cancer, or other solid tumors.

In one aspect, the present invention provides methods of treating cancer by providing to the subject in need thereof immune effector cells (e.g., T cells, NK cells) that are engineered to express an EphA2CAR, wherein the cancer cells express EphA2. In one embodiment, the cancer to be treated is GBM.

In one aspect, the present invention provides methods of treating cancer by providing to the subject in need thereof immune effector cells (e.g., T cells, NK cells) that are engineered to express a GD3CAR, wherein the cancer cells express GD3. In one embodiment, the cancer to be treated is melanoma.

In one aspect, the present invention provides methods of treating cancer by providing to the subject in need thereof immune effector cells (e.g., T cells, NK cells) that are engineered to express a Fucosyl GM1CAR, wherein the cancer cells express Fucosyl GM In one aspect, the present invention provides methods of treating cancer by providing to the subject in need thereof immune effector cells (e.g., T cells, NK cells) that are engineered to express a sLeCAR, wherein the cancer cells express sLe. In one embodiment, the cancer to be treated is NSCLC, or AML.

In one aspect, the present invention provides methods of treating cancer by providing to the subject in need thereof immune effector cells (e.g., T cells, NK cells) that are engineered to express a GM3CAR, wherein the cancer cells express GM3.

In one aspect, the present invention provides methods of treating cancer by providing to the subject in need thereof immune effector cells (e.g., T cells, NK cells) that are engineered to express a TGS5CAR, wherein the cancer cells express TGS5.

In one aspect, the present invention provides methods of treating cancer by providing to the subject in need thereof immune effector cells (e.g., T cells, NK cells) that are engineered to express a HMWMAACAR, wherein the cancer cells express HMWMAA. In one embodiment, the cancer to be treated is melanoma, glioblastoma, or breast cancer.

In one aspect, the present invention provides methods of treating cancer by providing to the subject in need thereof immune effector cells (e.g., T cells, NK cells) that are engineered to express an o-acetyl-GD2CAR, wherein the cancer cells express o-acetyl-GD2. In one embodiment, the cancer to be treated is neuroblastoma, or melanoma.

In one aspect, the present invention provides methods of treating cancer by providing to the subject in need thereof immune effector cells (e.g., T cells, NK cells) that are engineered to express a CD19CAR, wherein the cancer cells express CD19. In one embodiment, the cancer to be treated is Follicular lymphoma, CLL, ALL, or myeloma.

In one aspect, the present invention provides methods of treating cancer by providing to the subject in need thereof immune effector cells (e.g., T cells, NK cells) that are engineered to express a TEM1/CD248CAR, wherein the cancer cells express TEM1/CD248. In one embodiment, the cancer to be treated is a solid tumor.

In one aspect, the present invention provides methods of treating cancer by providing to the subject in need thereof immune effector cells (e.g., T cells, NK cells) that are engineered to express a TEM7RCAR, wherein the cancer cells express TEM7R. In one embodiment, the cancer to be treated is solid tumor.

In one aspect, the present invention provides methods of treating cancer by providing to the subject in need thereof immune effector cells (e.g., T cells, NK cells) that are engineered to express a CLDN6CAR, wherein the cancer cells express CLDN6. In one embodiment, the cancer to be treated is ovarian cancer, lung cancer, or breast cancer.

In one aspect, the present invention provides methods of treating cancer by providing to the subject in need thereof immune effector cells (e.g., T cells, NK cells) that are engineered to express a TSHRCAR, wherein the cancer cells express TSHR. In one embodiment, the cancer to be treated is thyroid cancer, or multiple myeloma.

In one aspect, the present invention provides methods of treating cancer by providing to the subject in need thereof immune effector cells (e.g., T cells, NK cells) that are engineered to express a GPRC5DCAR, wherein the cancer cells express GPRC5D. In one embodiment, the cancer to be treated is multiple myeloma.

In one aspect, the present invention provides methods of treating cancer by providing to the subject in need thereof immune effector cells (e.g., T cells, NK cells) that are engineered to express a CXORF61CAR, wherein the cancer cells express CXORF61.

In one aspect, the present invention provides methods of treating cancer by providing to the subject in need thereof immune effector cells (e.g., T cells, NK cells) that are engineered to express a CD97CAR, wherein the cancer cells express CD97. In one embodiment, the cancer to be treated is B cell malignancies, gastric cancer, pancreatic cancer, esophageal cancer, glioblastoma, breast cancer, or colorectal cancer.

In one aspect, the present invention provides methods of treating cancer by providing to the subject in need thereof immune effector cells (e.g., T cells, NK cells) that are engineered to express a CD179aCAR, wherein the cancer cells express CD179a. In one embodiment, the cancer to be treated is B cell malignancies.

In one aspect, the present invention provides methods of treating cancer by providing to the subject in need thereof immune effector cells (e.g., T cells, NK cells) that are engineered to express an ALK CAR, wherein the cancer cells express ALK. In one embodiment, the cancer to be treated is NSCLC, ALCL (anaplastic large cell lymphoma), IMT (inflammatory myofibroblastic tumor), or neuroblastoma.

In one aspect, the present invention provides methods of treating cancer by providing to the subject in need thereof immune effector cells (e.g., T cells, NK cells) that are engineered to express a Polysialic acid CAR, wherein the cancer cells express Polysialic acid. In one embodiment, the cancer to be treated is small cell lung cancer.

In one aspect, the present invention provides methods of treating cancer by providing to the subject in need thereof immune effector cells (e.g., T cells, NK cells) that are engineered to express a PLAC1CAR, wherein the cancer cells express PLAC1. In one embodiment, the cancer to be treated is HCC (hepatocellular carcinoma).

In one aspect, the present invention provides methods of treating cancer by providing to the subject in need thereof immune effector cells (e.g., T cells, NK cells) that are engineered to express a GloboHCAR, wherein the cancer cells express GloboH. In one embodiment, the cancer to be treated is ovarian cancer, gastric cancer, prostate cancer, lung cancer, breast cancer, or pancreatic cancer.

In one aspect, the present invention provides methods of treating cancer by providing to the subject in need thereof immune effector cells (e.g., T cells, NK cells) that are engineered to express a NY-BR-1CAR, wherein the cancer cells express NY-BR-1. In one embodiment, the cancer to be treated is breast cancer.

In one aspect, the present invention provides methods of treating cancer by providing to the subject in need thereof immune effector cells (e.g., T cells, NK cells) that are engineered to express a UPK2CAR, wherein the cancer cells express UPK2. In one embodiment, the cancer to be treated is bladder cancer.

In one aspect, the present invention provides methods of treating cancer by providing to the subject in need thereof immune effector cells (e.g., T cells, NK cells) that are engineered to express a HAVCR1CAR, wherein the cancer cells express HAVCR1. In one embodiment, the cancer to be treated is renal cancer.

In one aspect, the present invention provides methods of treating cancer by providing to the subject in need thereof immune effector cells (e.g., T cells, NK cells) that are engineered to express a ADRB3CAR, wherein the cancer cells express ADRB3. In one embodiment, the cancer to be treated is Ewing sarcoma.

In one aspect, the present invention provides methods of treating cancer by providing to the subject in need thereof immune effector cells (e.g., T cells, NK cells) that are engineered to express a PANX3CAR, wherein the cancer cells express PANX3. In one embodiment, the cancer to be treated is osteosarcoma.

In one aspect, the present invention provides methods of treating cancer by providing to the subject in need thereof immune effector cells (e.g., T cells, NK cells) that are engineered to express a GPR20CAR, wherein the cancer cells express GPR20. In one embodiment, the cancer to be treated is GIST.

In one aspect, the present invention provides methods of treating cancer by providing to the subject in need thereof immune effector cells (e.g., T cells, NK cells) that are engineered to express a LY6KCAR, wherein the cancer cells express LY6K. In one embodiment, the cancer to be treated is breast cancer, lung cancer, ovary caner, or cervix cancer.

In one aspect, the present invention provides methods of treating cancer by providing to the subject in need thereof immune effector cells (e.g., T cells, NK cells) that are engineered to express a OR51E2CAR, wherein the cancer cells express OR51E2. In one embodiment, the cancer to be treated is prostate cancer.

In one aspect, the present invention provides methods of treating cancer by providing to the subject in need thereof immune effector cells (e.g., T cells, NK cells) that are engineered to express a TARPCAR, wherein the cancer cells express TARP. In one embodiment, the cancer to be treated is prostate cancer.

In one aspect, the present invention provides methods of treating cancer by providing to the subject in need thereof immune effector cells (e.g., T cells, NK cells) that are engineered to express a WT1CAR, wherein the cancer cells express WT1.

In one aspect, the present invention provides methods of treating cancer by providing to the subject in need thereof immune effector cells (e.g., T cells, NK cells) that are engineered to express a NY-ESO-1CAR, wherein the cancer cells express NY-ESO-1.

In one aspect, the present invention provides methods of treating cancer by providing to the subject in need thereof immune effector cells (e.g., T cells, NK cells) that are engineered to express a LAGE-1a CAR, wherein the cancer cells express LAGE-1a.

In one aspect, the present invention provides methods of treating cancer by providing to the subject in need thereof immune effector cells (e.g., T cells, NK cells) that are engineered to express a MAGE-A1CAR, wherein the cancer cells express MAGE-A1. In one embodiment, the cancer to be treated is melanoma.

In one aspect, the present invention provides methods of treating cancer by providing to the subject in need thereof immune effector cells (e.g., T cells, NK cells) that are engineered to express a MAGE A1CAR, wherein the cancer cells express MAGE A1.

In one aspect, the present invention provides methods of treating cancer by providing to the subject in need thereof immune effector cells (e.g., T cells, NK cells) that are engineered to express a ETV6-AML CAR, wherein the cancer cells express ETV6-AML.

In one aspect, the present invention provides methods of treating cancer by providing to the subject in need thereof immune effector cells (e.g., T cells, NK cells) that are engineered to express a sperm protein 17 CAR, wherein the cancer cells express sperm protein 17. In one embodiment, the cancer to be treated is ovarian cancer, HCC, or NSCLC.

In one aspect, the present invention provides methods of treating cancer by providing to the subject in need thereof immune effector cells (e.g., T cells, NK cells) that are engineered to express a XAGE1CAR, wherein the cancer cells express XAGE1. In one embodiment, the cancer to be treated is Ewings, or rhabdo cancer.

In one aspect, the present invention provides methods of treating cancer by providing to the subject in need thereof immune effector cells (e.g., T cells, NK cells) that are engineered to express a Tie 2 CAR, wherein the cancer cells express Tie 2. In one embodiment, the cancer to be treated is a solid tumor.

In one aspect, the present invention provides methods of treating cancer by providing to the subject in need thereof immune effector cells (e.g., T cells, NK cells) that are engineered to express a MAD-CT-1CAR, wherein the cancer cells express MAD-CT-1. In one embodiment, the cancer to be treated is prostate cancer, or melanoma.

In one aspect, the present invention provides methods of treating cancer by providing to the subject in need thereof immune effector cells (e.g., T cells, NK cells) that are engineered to express a MAD-CT-2CAR, wherein the cancer cells express MAD-CT-2. In one embodiment, the cancer to be treated is prostate cancer, melanoma.

In one aspect, the present invention provides methods of treating cancer by providing to the subject in need thereof immune effector cells (e.g., T cells, NK cells) that are engineered to express a Fos-related antigen 1 CAR, wherein the cancer cells express Fos-related antigen 1. In one embodiment, the cancer to be treated is glioma, squamous cell cancer, or pancreatic cancer.

In one aspect, the present invention provides methods of treating cancer by providing to the subject in need thereof immune effector cells (e.g., T cells, NK cells) that are engineered to express a p53CAR, wherein the cancer cells express p53.

In one aspect, the present invention provides methods of treating cancer by providing to the subject in need thereof immune effector cells (e.g., T cells, NK cells) that are engineered to express a prostein CAR, wherein the cancer cells express prostein.

In one aspect, the present invention provides methods of treating cancer by providing to the subject in need thereof immune effector cells (e.g., T cells, NK cells) that are engineered to express a survivin and telomerase CAR, wherein the cancer cells express survivin and telomerase.

In one aspect, the present invention provides methods of treating cancer by providing to the subject in need thereof immune effector cells (e.g., T cells, NK cells) that are engineered to express a PCTA-1/Galectin 8 CAR, wherein the cancer cells express PCTA-1/Galectin 8.

In one aspect, the present invention provides methods of treating cancer by providing to the subject in need thereof immune effector cells (e.g., T cells, NK cells) that are engineered to express a MelanA/MART1CAR, wherein the cancer cells express MelanA/MART1.

In one aspect, the present invention provides methods of treating cancer by providing to the subject in need thereof immune effector cells (e.g., T cells, NK cells) that are engineered to express a Ras mutant CAR, wherein the cancer cells express Ras mutant.

In one aspect, the present invention provides methods of treating cancer by providing to the subject in need thereof immune effector cells (e.g., T cells, NK cells) that are engineered to express a p53 mutant CAR, wherein the cancer cells express p53 mutant.

In one aspect, the present invention provides methods of treating cancer by providing to the subject in need thereof immune effector cells (e.g., T cells, NK cells) that are engineered to express a hTERT CAR, wherein the cancer cells express hTERT.

In one aspect, the present invention provides methods of treating cancer by providing to the subject in need thereof immune effector cells (e.g., T cells, NK cells) that are engineered to express a sarcoma translocation breakpoints CAR, wherein the cancer cells express sarcoma translocation breakpoints. In one embodiment, the cancer to be treated is sarcoma.

In one aspect, the present invention provides methods of treating cancer by providing to the subject in need thereof immune effector cells (e.g., T cells, NK cells) that are engineered to express a ML-IAP CAR, wherein the cancer cells express ML-IAP. In one embodiment, the cancer to be treated is melanoma.

In one aspect, the present invention provides methods of treating cancer by providing to the subject in need thereof immune effector cells (e.g., T cells, NK cells) that are engineered to express an ERGCAR, wherein the cancer cells express ERG (TMPRSS2 ETS fusion gene).

In one aspect, the present invention provides methods of treating cancer by providing to the subject in need thereof immune effector cells (e.g., T cells, NK cells) that are engineered to express a NA17CAR, wherein the cancer cells express NA17. In one embodiment, the cancer to be treated is melanoma.

In one aspect, the present invention provides methods of treating cancer by providing to the subject in need thereof immune effector cells (e.g., T cells, NK cells) that are engineered to express a PAX3CAR, wherein the cancer cells express PAX3. In one embodiment, the cancer to be treated is alveolar rhabdomyosarcoma.

In one aspect, the present invention provides methods of treating cancer by providing to the subject in need thereof immune effector cells (e.g., T cells, NK cells) that are engineered to express an androgen receptor CAR, wherein the cancer cells express androgen receptor. In one embodiment, the cancer to be treated is metastatic prostate cancer.

In one aspect, the present invention provides methods of treating cancer by providing to the subject in need thereof immune effector cells (e.g., T cells, NK cells) that are engineered to express a Cyclin B1CAR, wherein the cancer cells express Cyclin B1.

In one aspect, the present invention provides methods of treating cancer by providing to the subject in need thereof immune effector cells (e.g., T cells, NK cells) that are engineered to express a MYCNCAR, wherein the cancer cells express MYCN.

In one aspect, the present invention provides methods of treating cancer by providing to the subject in need thereof immune effector cells (e.g., T cells, NK cells) that are engineered to express a RhoC CAR, wherein the cancer cells express RhoC.

In one aspect, the present invention provides methods of treating cancer by providing to the subject in need thereof immune effector cells (e.g., T cells, NK cells) that are engineered to express a TRP-2CAR, wherein the cancer cells express TRP-2. In one embodiment, the cancer to be treated is melanoma.

In one aspect, the present invention provides methods of treating cancer by providing to the subject in need thereof immune effector cells (e.g., T cells, NK cells) that are engineered to express a CYP1B1CAR, wherein the cancer cells express CYP1B1. In one embodiment, the cancer to be treated is breast cancer, colon cancer, lung cancer, esophagus cancer, skin cancer, lymph node cancer, brain cancer, or testis cancer.

In one aspect, the present invention provides methods of treating cancer by providing to the subject in need thereof immune effector cells (e.g., T cells, NK cells) that are engineered to express a BORIS CAR, wherein the cancer cells express BORIS. In one embodiment, the cancer to be treated is lung cancer.

In one aspect, the present invention provides methods of treating cancer by providing to the subject in need thereof immune effector cells (e.g., T cells, NK cells) that are engineered to express a SART3CAR, wherein the cancer cells express SART3

In one aspect, the present invention provides methods of treating cancer by providing to the subject in need thereof immune effector cells (e.g., T cells, NK cells) that are engineered to express a PAX5CAR, wherein the cancer cells express PAX5.

In one aspect, the present invention provides methods of treating cancer by providing to the subject in need thereof immune effector cells (e.g., T cells, NK cells) that are engineered to express a OY-TES1CAR, wherein the cancer cells express OY-TES1.

In one aspect, the present invention provides methods of treating cancer by providing to the subject in need thereof immune effector cells (e.g., T cells, NK cells) that are engineered to express a LCK CAR, wherein the cancer cells express LCK.

In one aspect, the present invention provides methods of treating cancer by providing to the subject in need thereof immune effector cells (e.g., T cells, NK cells) that are engineered to express a AKAP-4CAR, wherein the cancer cells express AKAP-4.

In one aspect, the present invention provides methods of treating cancer by providing to the subject in need thereof immune effector cells (e.g., T cells, NK cells) that are engineered to express a SSX2CAR, wherein the cancer cells express SSX2.

In one aspect, the present invention provides methods of treating cancer by providing to the subject in need thereof immune effector cells (e.g., T cells, NK cells) that are engineered to express a RAGE-1CAR, wherein the cancer cells express RAGE-1. In one embodiment, the cancer to be treated is RCC (renal cell cancer), or other solid tumors In one aspect, the present invention provides methods of treating cancer by providing to the subject in need thereof immune effector cells (e.g., T cells, NK cells) that are engineered to express a human telomerase reverse transcriptase CAR, wherein the cancer cells express human telomerase reverse transcriptase. In one embodiment, the cancer to be treated is solid tumors.

In one aspect, the present invention provides methods of treating cancer by providing to the subject in need thereof immune effector cells (e.g., T cells, NK cells) that are engineered to express a RU1CAR, wherein the cancer cells express RU1.

In one aspect, the present invention provides methods of treating cancer by providing to the subject in need thereof immune effector cells (e.g., T cells, NK cells) that are engineered to express a RU2CAR, wherein the cancer cells express RU2.

In one aspect, the present invention provides methods of treating cancer by providing to the subject in need thereof immune effector cells (e.g., T cells, NK cells) that are engineered to express an intestinal carboxyl esterase CAR, wherein the cancer cells express intestinal carboxyl esterase. In one embodiment, the cancer to be treated is thyroid cancer, RCC, CRC (colorectal cancer), breast cancer, or other solid tumors.

In one aspect, the present invention provides methods of treating cancer by providing to the subject in need thereof immune effector cells (e.g., T cells, NK cells) that are engineered to express a Prostase CAR, wherein the cancer cells express Prostase.

In one aspect, the present invention provides methods of treating cancer by providing to the subject in need thereof immune effector cells (e.g., T cells, NK cells) that are engineered to express a PAPCAR, wherein the cancer cells express PAP.

In one aspect, the present invention provides methods of treating cancer by providing to the subject in need thereof immune effector cells (e.g., T cells, NK cells) that are engineered to express an IGF-I receptor CAR, wherein the cancer cells express IGF-I receptor.

In one aspect, the present invention provides methods of treating cancer by providing to the subject in need thereof immune effector cells (e.g., T cells, NK cells) that are engineered to express a gp100 CAR, wherein the cancer cells express gp100.

In one aspect, the present invention provides methods of treating cancer by providing to the subject in need thereof immune effector cells (e.g., T cells, NK cells) that are engineered to express a bcr-abl CAR, wherein the cancer cells express bcr-abl.

In one aspect, the present invention provides methods of treating cancer by providing to the subject in need thereof immune effector cells (e.g., T cells, NK cells) that are engineered to express a tyrosinase CAR, wherein the cancer cells express tyrosinase.

In one aspect, the present invention provides methods of treating cancer by providing to the subject in need thereof immune effector cells (e.g., T cells, NK cells) that are engineered to express a Fucosyl GM1CAR, wherein the cancer cells express Fucosyl GME In one aspect, the present invention provides methods of treating cancer by providing to the subject in need thereof immune effector cells (e.g., T cells, NK cells) that are engineered to express a mut hsp70-2CAR, wherein the cancer cells express mut hsp70-2. In one embodiment, the cancer to be treated is melanoma.

In one aspect, the present invention provides methods of treating cancer by providing to the subject in need thereof immune effector cells (e.g., T cells, NK cells) that are engineered to express a CD79a CAR, wherein the cancer cells express CD79a.

In one aspect, the present invention provides methods of treating cancer by providing to the subject in need thereof immune effector cells (e.g., T cells, NK cells) that are engineered to express a CD79b CAR, wherein the cancer cells express CD79b.

In one aspect, the present invention provides methods of treating cancer by providing to the subject in need thereof immune effector cells (e.g., T cells, NK cells) that are engineered to express a CD72 CAR, wherein the cancer cells express CD72.

In one aspect, the present invention provides methods of treating cancer by providing to the subject in need thereof immune effector cells (e.g., T cells, NK cells) that are engineered to express a LAIR1 CAR, wherein the cancer cells express LAIR1.

In one aspect, the present invention provides methods of treating cancer by providing to the subject in need thereof immune effector cells (e.g., T cells, NK cells) that are engineered to express a FCAR CAR, wherein the cancer cells express FCAR.

In one aspect, the present invention provides methods of treating cancer by providing to the subject in need thereof immune effector cells (e.g., T cells, NK cells) that are engineered to express a LILRA2 CAR, wherein the cancer cells express LILRA2.

In one aspect, the present invention provides methods of treating cancer by providing to the subject in need thereof immune effector cells (e.g., T cells, NK cells) that are engineered to express a CD300LF CAR, wherein the cancer cells express CD300LF.

In one aspect, the present invention provides methods of treating cancer by providing to the subject in need thereof immune effector cells (e.g., T cells, NK cells) that are engineered to express a CLEC12A CAR, wherein the cancer cells express CLEC12A.

In one aspect, the present invention provides methods of treating cancer by providing to the subject in need thereof immune effector cells (e.g., T cells, NK cells) that are engineered to express a BST2 CAR, wherein the cancer cells express BST2.

In one aspect, the present invention provides methods of treating cancer by providing to the subject in need thereof immune effector cells (e.g., T cells, NK cells) that are engineered to express an EMR2 CAR, wherein the cancer cells express EMR2.

In one aspect, the present invention provides methods of treating cancer by providing to the subject in need thereof immune effector cells (e.g., T cells, NK cells) that are engineered to express a LY75 CAR, wherein the cancer cells express LY75.

In one aspect, the present invention provides methods of treating cancer by providing to the subject in need thereof immune effector cells (e.g., T cells, NK cells) that are engineered to express a GPC3 CAR, wherein the cancer cells express GPC3.

In one aspect, the present invention provides methods of treating cancer by providing to the subject in need thereof immune effector cells (e.g., T cells, NK cells) that are engineered to express a FCRL5 CAR, wherein the cancer cells express FCRL5.

In one aspect, the present invention provides methods of treating cancer by providing to the subject in need thereof immune effector cells (e.g., T cells, NK cells) that are engineered to express an IGLL1 CAR, wherein the cancer cells express IGLL1.

In one aspect, the present invention relates to treatment of a subject in vivo using an PD1 CAR such that growth of cancerous tumors is inhibited. A PD1 CAR may be used alone to inhibit the growth of cancerous tumors. Alternatively, PD1 CAR may be used in conjunction with other CARs, immunogenic agents, standard cancer treatments, or other antibodies. In one embodiment, the subject is treated with a PD1 CAR and an XCAR described herein. In an embodiment, a PD1 CAR is used in conjunction with another CAR, e.g., a CAR described herein, and a kinase inhibitor, e.g., a kinase inhibitor described herein.

In another aspect, a method of treating a subject, e.g., reducing or ameliorating, a hyperproliferative condition or disorder (e.g., a cancer), e.g., solid tumor, a soft tissue tumor, or a metastatic lesion, in a subject is provided. As used herein, the term "cancer" is meant to include all types of cancerous growths or oncogenic processes, metastatic tissues or malignantly transformed cells, tissues, or organs, irrespective of histopathologic type or stage of invasiveness. Examples of solid tumors include malignancies, e.g., sarcomas, adenocarcinomas, and carcinomas, of the various organ systems, such as those affecting liver, lung, breast, lymphoid, gastrointestinal (e.g., colon), genitourinary tract (e.g., renal, urothelial cells), prostate and pharynx. Adenocarcinomas include malignancies such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the invention. Examples of other cancers that can be treated include bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers.

Treatment of metastatic cancers, e.g., metastatic cancers that express PD-L1 (Iwai et al. (2005) Int. Immunol. 17:133-144) can be effected using the antibody molecules described herein.

Exemplary cancers whose growth can be inhibited include cancers typically responsive to immunotherapy. Non-limiting examples of cancers for treatment include melanoma (e.g., metastatic malignant melanoma), renal cancer (e.g. clear cell carcinoma), prostate cancer (e.g. hormone refractory prostate adenocarcinoma), breast cancer, colon cancer and lung cancer (e.g. non-small cell lung cancer). Additionally, refractory or recurrent malignancies can be treated using the molecules described herein.

In one aspect, the invention pertains to a vector comprising a CAR operably linked to promoter for expression in mammalian immune effector cells (e.g., T cells, NK cells). In one aspect, the invention provides a recombinant immune effector cell expressing a CAR of the present invention for use in treating cancer expressing a cancer associate antigen as described herein. In one aspect, CAR-expressing cells of the invention is capable of contacting a tumor cell with at least one cancer associated antigen expressed on its surface such that the CAR-expressing cell targets the cancer cell and growth of the cancer is inhibited.

In one aspect, the invention pertains to a method of inhibiting growth of a cancer, comprising contacting the cancer cell with a CAR-expressing cell of the present invention such that the CART is activated in response to the antigen and targets the cancer cell, wherein the growth of the tumor is inhibited.

In one aspect, the invention pertains to a method of treating cancer in a subject. The method comprises administering to the subject CAR-expressing cell of the present invention such that the cancer is treated in the subject. In one aspect, the cancer associated with expression of a cancer associate antigen as described herein is a hematological cancer. In one aspect, the hematological cancer is a leukemia or a lymphoma. In one aspect, a cancer associated with expression of a cancer associate antigen as described herein includes cancers and malignancies including, but not limited to, e.g., one or more acute leukemias including but not limited to, e.g., B-cell acute Lymphoid Leukemia ("BALL"), T-cell acute Lymphoid Leukemia ("TALL"), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of a cancer associate antigen as described herein include, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression include, but not limited to, e.g., atypical and/or non-classical cancers, malignancies, precancerous conditions or proliferative diseases associated with expression of a cancer associate antigen as described herein.

In some embodiments, a cancer that can be treated with CAR-expressing cell of the present invention is multiple myeloma. Multiple myeloma is a cancer of the blood, characterized by accumulation of a plasma cell clone in the bone marrow. Current therapies for multiple myeloma include, but are not limited to, treatment with lenalidomide, which is an analog of thalidomide. Lenalidomide has activities which include anti-tumor activity, angiogenesis inhibition, and immunomodulation. Generally, myeloma cells are thought to be negative for a cancer associate antigen as described herein expression by flow cytometry. Thus, in some embodiments, a CD19 CAR, e.g., as described herein, may be used to target myeloma cells. In some embodiments, cars of the present invention therapy can be used in combination with one or more additional therapies, e.g., lenalidomide treatment.

The invention includes a type of cellular therapy where immune effector cells (e.g., T cells, NK cells) are genetically modified to express a chimeric antigen receptor (CAR) and the CAR-expressing T cell or NK cell is infused to a recipient in need thereof. The infused cell is able to kill tumor cells in the recipient. Unlike antibody therapies, CAR-modified immune effector cells (e.g., T cells, NK cells) are able to replicate in vivo resulting in long-term persistence that can lead to sustained tumor control. In various aspects, the immune effector cells (e.g., T cells, NK cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell or NK cell to the patient.

The invention also includes a type of cellular therapy where immune effector cells (e.g., T cells, NK cells) are modified, e.g., by in vitro transcribed RNA, to transiently express a chimeric antigen receptor (CAR) and the CAR T cell or NK cell is infused to a recipient in need thereof. The infused cell is able to kill tumor cells in the recipient. Thus, in various aspects, the immune effector cells (e.g., T cells, NK cells) administered to the patient, is present for less than one month, e.g., three weeks, two weeks, one week, after administration of the T cell or NK cell to the patient.

Without wishing to be bound by any particular theory, the anti-tumor immunity response elicited by the CAR-modified immune effector cells (e.g., T cells, NK cells) may be an active or a passive immune response, or alternatively may be due to a direct vs indirect immune response. In one aspect, the CAR transduced immune effector cells (e.g., T cells, NK cells) exhibit specific proinflammatory cytokine secretion and potent cytolytic activity in response to human cancer cells expressing the a cancer associate antigen as described herein, resist soluble a cancer associate antigen as described herein inhibition, mediate bystander killing and mediate regression of an established human tumor. For example, antigen-less tumor cells within a heterogeneous field of a cancer associate antigen as described herein-expressing tumor may be susceptible to indirect destruction by a cancer associate antigen as described herein-redirected immune effector cells (e.g., T cells, NK cells) that has previously reacted against adjacent antigen-positive cancer cells.

In one aspect, the fully-human CAR-modified immune effector cells (e.g., T cells, NK cells) of the invention may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a CAR to the cells or iii) cryopreservation of the cells.

Ex vivo procedures are well known in the art and are discussed more fully below. Briefly, cells are isolated from a mammal (e.g., a human) and genetically modified (i.e., transduced or transfected in vitro) with a vector expressing a CAR disclosed herein. The CAR-modified cell can be administered to a mammalian recipient to provide a therapeutic benefit. The mammalian recipient may be a human and the CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of immune effector cells (e.g., T cells, NK cells) comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified immune effector cells (e.g., T cells, NK cells) of the invention are used in the treatment of diseases, disorders and conditions associated with expression of a cancer associate antigen as described herein. In certain aspects, the cells of the invention are used in the treatment of patients at risk for developing diseases, disorders and conditions associated with expression of a cancer associate antigen as described herein. Thus, the present invention provides methods for the treatment or prevention of diseases, disorders and conditions associated with expression of a cancer associate antigen as described herein comprising administering to a subject in need thereof, a therapeutically effective amount of the CAR-modified immune effector cells (e.g., T cells, NK cells) of the invention.

In one aspect the CAR-expressing cells of the inventions may be used to treat a proliferative disease such as a cancer or malignancy or is a precancerous condition such as a myelodysplasia, a myelodysplastic syndrome or a preleukemia. Further a disease associated with a cancer associate antigen as described herein expression include, but not limited to, e.g., atypical and/or non-classical cancers, malignancies, precancerous conditions or proliferative diseases expressing a cancer associated antigen as described herein. Non-cancer related indications associated with expression of a cancer associate antigen as described herein include, but are not limited to, e.g., autoimmune disease, (e.g., lupus), inflammatory disorders (allergy and asthma) and transplantation.

The CAR-modified immune effector cells (e.g., T cells, NK cells) of the present invention may be administered either alone, or as a pharmaceutical composition in combination with diluents and/or with other components such as IL-2 or other cytokines or cell populations.

Hematologic Cancer

Hematological cancer conditions are the types of cancer such as leukemia, lymphoma, and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

The present invention provides for compositions and methods for treating cancer. In one aspect, the cancer is a hematologic cancer including but is not limited to hematological cancer is a leukemia or a lymphoma. In one aspect, the CAR-expressing cells of the invention may be used to treat cancers and malignancies such as, but not limited to, e.g., acute leukemias including but not limited to, e.g., B-cell acute lymphoid leukemia ("BALL"), T-cell acute lymphoid leukemia ("TALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression includes, but not limited to, e.g., atypical and/or non-classical cancers, malignancies, precancerous conditions or proliferative diseases expressing a cancer associate antigen as described herein.

The present invention also provides methods for inhibiting the proliferation or reducing a cancer associated antigen as described herein-expressing cell population, the methods comprising contacting a population of cells comprising a cancer associated antigen as described herein-expressing cell with a CAR-expressing T cell or NK cell of the invention that binds to the a cancer associate antigen as described herein-expressing cell. In a specific aspect, the present invention provides methods for inhibiting the proliferation or reducing the population of cancer cells expressing a cancer associated antigen as described herein, the methods comprising contacting a cancer associate antigen as described herein-expressing cancer cell population with a CAR-expressing T cell or NK cell of the invention that binds to a cancer associated antigen as described herein-expressing cell. In one aspect, the present invention provides methods for inhibiting the proliferation or reducing the population of cancer cells expressing a cancer associated antigen as described herein, the methods comprising contacting a cancer associated antigen as described herein-expressing cancer cell population with a CAR-expressing T cell or NK cell of the invention that binds to a cancer associated antigen as described herein-expressing cell. In certain aspects, a CAR-expressing T cell or NK cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with a cancer associated antigen as described herein-expressing cells relative to a negative control. In one aspect, the subject is a human.

The present invention also provides methods for preventing, treating and/or managing a disease associated with a cancer associated antigen as described herein-expressing cells (e.g., a hematologic cancer or atypical cancer expressing a cancer associated antigen as described herein), the methods comprising administering to a subject in need a CAR T cell or NK cell of the invention that binds to a cancer associated antigen as described herein-expressing cell. In one aspect, the subject is a human. Non-limiting examples of disorders associated with a cancer associated antigen as described herein-expressing cells include autoimmune disorders (such as lupus), inflammatory disorders (such as allergies and asthma) and cancers (such as hematological cancers or atypical cancers expressing a cancer associated antigen as described herein).

The present invention also provides methods for preventing, treating and/or managing a disease associated with a cancer associated antigen as described herein-expressing cells, the methods comprising administering to a subject in need a CAR T cell or NK cell of the invention that binds to a cancer associated antigen as described herein-expressing cell. In one aspect, the subject is a human The present invention provides methods for preventing relapse of cancer associated with a cancer associated antigen as described herein-expressing cells, the methods comprising administering to a subject in need thereof a CAR T cell or NK cell of the invention that binds to a cancer associated antigen as described herein-expressing cell. In one aspect, the methods comprise administering to the subject in need thereof an effective amount of a CAR-expressing T cell or NK cell described herein that binds to a cancer associated antigen as described herein-expressing cell in combination with an effective amount of another therapy.

Combination Therapies

A CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

The CAR therapy and/or other therapeutic agents, procedures or modalities can be administered during periods of active disorder, or during a period of remission or less active disease. The CAR therapy can be administered before the other treatment, concurrently with the treatment, post-treatment, or during remission of the disorder.

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In certain embodiments of the methods or uses described herein, the CAR molecule is administered in combination with an agent that increases the efficacy of the immune effector cell, e.g., one or more of a protein phosphatase inhibitor, a kinase inhibitor, a cytokine, an inhibitor of an immune inhibitory molecule; or an agent that decreases the level or activity of a $T_{REG}$ cell.

In certain embodiments of the methods or uses described herein, the protein phosphatase inhibitor is a SHP-1 inhibitor and/or an SHP-2 inhibitor.

In other embodiments of the methods or uses described herein, kinase inhibitor is chosen from one or more of a CDK4 inhibitor, a CDK4/6 inhibitor (e.g., palbociclib), a BTK inhibitor (e.g., ibrutinib or RN-486), an mTOR inhibitor (e.g., rapamycin or everolimus (RAD001)), an MNK inhibitor, or a dual P13K/mTOR inhibitor. In one embodiment, the BTK inhibitor does not reduce or inhibit the kinase activity of interleukin-2-inducible kinase (ITK).

In other embodiments of the methods or uses described herein, the agent that inhibits the immune inhibitory molecule comprises an antibody or antibody fragment, an inhibitory nucleic acid, a clustered regularly interspaced short palindromic repeats (CRISPR), a transcription-activator like effector nuclease (TALEN), or a zinc finger endonuclease (ZFN) that inhibits the expression of the inhibitory molecule.

In other embodiments of the methods or uses described herein, the agent that decreases the level or activity of the $T_{REG}$ cells is chosen from cyclophosphamide, anti-GITR antibody, CD25-depletion, or a combination thereof.

In certain embodiments of the methods or uses described herein, the immune inhibitory molecule is selected from the group consisting of PD1, PD-L1, CTLA-4, TIM-3, LAG-3, VISTA, BTLA, TIGIT, LAIR1, CD160, 2B4, TGF beta, CEACAM-1, CEACAM-3, and CEACAM-5.

In other embodiments, the agent that inhibits the inhibitory molecule comprises a first polypeptide comprising an inhibitory molecule or a fragment thereof and a second polypeptide that provides a positive signal to the cell, and wherein the first and second polypeptides are expressed on the CAR-containing immune cells, wherein (i) the first polypeptide comprises PD1, PD-L1, CTLA-4, TIM-3, LAG3, VISTA, BTLA, TIGIT, LAIR1, CD160, 2B4, TGF beta, CEACAM-1, CEACAM-3, and CEACAM-5 or a fragment thereof; and/or (ii) the second polypeptide comprises an intracellular signaling domain comprising a primary signaling domain and/or a costimulatory signaling domain. In one embodiment, the primary signaling domain comprises a functional domain of CD3 zeta, or a functional variant thereof; and/or the costimulatory signaling domain comprises a functional domain of a protein selected from 41BB, CD27 and CD28, or a functional variant thereof.

In other embodiments, cytokine is chosen from IL-7, IL-15 or IL-21, or both.

In other embodiments, the immune effector cell comprising the CAR molecule and a second, e.g., any of the combination therapies disclosed herein (e.g., the agent that that increases the efficacy of the immune effector cell) are administered substantially simultaneously or sequentially.

In other embodiments, the immune cell comprising the CAR molecule is administered in combination with a molecule that targets GITR and/or modulates GITR function. In certain embodiments, the molecule targeting GITR and/or modulating GITR function is administered prior to the CAR-expressing cell or population of cells, or prior to apheresis.

In one embodiment, lymphocyte infusion, for example allogeneic lymphocyte infusion, is used in the treatment of the cancer, wherein the lymphocyte infusion comprises at least one CAR-expressing cell of the present invention. In one embodiment, autologous lymphocyte infusion is used in the treatment of the cancer, wherein the autologous lymphocyte infusion comprises at least one CAR-expressing cell described herein.

In one embodiment, the cell is a T cell and the T cell is diacylglycerol kinase (DGK) deficient. In one embodiment, the cell is a T cell and the T cell is Ikaros deficient. In one embodiment, the cell is a T cell and the T cell is both DGK and Ikaros deficient.

In one embodiment, the method includes administering a cell expressing the CAR moleculein combination with an agent which enhances the activity of a CAR-expressing cell, wherein the agent is a cytokine, e.g., IL-7, IL-15, IL-21, or a combination thereof. The cytokine can be delivered in combination with, e.g., simultaneously or shortly after, administration of the CAR-expressing cell. Alternatively, the cytokine can be delivered after a prolonged period of time after administration of the CAR-expressing cell, e.g., after assessment of the subject's response to the CAR-expressing cell. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the cell or population of cells of any of claims 61-80. In other embodiments, the cytokine is administered to the subject after a prolonged period of time (e.g., e.g., at least 2 weeks, 3 weeks, 4 weeks, 6 weeks, 8 weeks, 10 weeks, or more) after administration of the cell or population of cells of any of claims 61-80, or after assessment of the subject's response to the cell.

In other embodiments, the cells expressing a CAR molecule are administered in combination with an agent that ameliorates one or more side effects associated with administration of a cell expressing a CAR molecule. Side effects associated with the CAR-expressing cell can be chosen from cytokine release syndrome (CRS) or hemophagocytic lymphohistiocytosis (HLH).

In embodiments of any of the aforesaid methods or uses, the cells expressing the CAR molecule are administered in combination with an agent that treats the disease associated with expression of the tumor antigen, e.g., any of the second or third therapies disclosed herein. Additional exemplary combinations include one or more of the following.

In another embodiment, the cell expressing the CAR molecule, e.g., as described herein, can be administered in combination with another agent, e.g., a kinase inhibitor and/or checkpoint inhibitor described herein. In an embodiment, a cell expressing the CAR molecule can further express another agent, e.g., an agent which enhances the activity of a CAR-expressing cell.

For example, in one embodiment, the agent that enhances the activity of a CAR-expressing cell can be an agent which inhibits an inhibitory molecule (e.g., an immune inhibitor molecule). Examples of inhibitory molecules include PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta.

In one embodiment, the agent that inhibits the inhibitory molecule is an inhibitory nucleic acid is a dsRNA, a siRNA, or a shRNA. In embodiments, the inhibitory nucleic acid is linked to the nucleic acid that encodes a component of the CAR molecule. For example, the inhibitory molecule can be expressed on the CAR-expressing cell.

In another embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta, or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein, or a functional variant thereof). In one embodiment, the agent comprises a first polypeptide of PD1 or a fragment thereof (e.g., at least a portion of the extracellular domain of PD1, or a functional variant thereof), and a second polypeptide of an intracellular signaling domain described herein (e.g., a CD28 signaling domain described herein and/or a CD3 zeta signaling domain described herein, or a functional variant thereof).

In one embodiment, the CAR-expressing immune effector cell of the present invention, e.g., T cell or NK cell, is administered to a subject that has received a previous stem cell transplantation, e.g., autologous stem cell transplantation.

In one embodiment, the CAR-expressing immune effector cell of the present invention, e.g., T cell or NK cells, is administered to a subject that has received a previous dose of melphalan.

In one embodiment, the cell expressing a CAR molecule, e.g., a CAR molecule described herein, is administered in combination with an agent that increases the efficacy of a cell expressing a CAR molecule, e.g., an agent described herein.

In one embodiment, the cells expressing a CAR molecule are administered in combination with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

In an embodiment this approach can be used to optimize the performance of CAR cells described herein in the subject. While not wishing to be bound by theory, it is believed that, in an embodiment, the performance of endogenous, non-modified immune effector cells, e.g., T cells or NK cells, is improved. While not wishing to be bound by theory, it is believed that, in an embodiment, the performance of a target antigen CAR-expressing cell is improved. In other embodiments, cells, e.g., T cells or NK cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells or NK cells. In an embodiment, the CAR cells are administered after a sufficient time, or sufficient dosing, of an mTOR inhibitor, such that the level of PD1 negative immune effector cells, e.g., T cells or NK cells, or the ratio of PD1 negative immune effector cells, e.g., T cells/PD1 positive immune effector cells, e.g., T cells, has been, at least transiently, increased.

In an embodiment, the cell, e.g., T cell or NK cell, to be engineered to express a CAR, is harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In one embodiment, the cell expressing a CAR molecule is administered in combination with an agent that ameliorates one or more side effect associated with administration of a cell expressing a CAR molecule, e.g., an agent described herein.

In one embodiment, the cell expressing a CAR molecule is administered in combination with an agent that treats the disease associated with a cancer associated antigen as described herein, e.g., an agent described herein.

In one embodiment, a cell expressing two or more CAR molecules, e.g., as described herein, is administered to a subject in need thereof to treat cancer. In one embodiment, a population of cells including a CAR expressing cell, e.g., as described herein, is administered to a subject in need thereof to treat cancer.

In one embodiment, the cell expressing a CAR molecule, is administered at a dose and/or dosing schedule described herein.

In one embodiment, the CAR molecule is introduced into immune effector cells (e.g., T cells, NK cells), e.g., using in vitro transcription, and the subject (e.g., human) receives an initial administration of cells comprising a CAR molecule and one or more subsequent administrations of cells comprising a CAR molecule wherein the one or more subsequent administrations are administered less than 15 days, e.g., 14, 13, 12, 11, 10, 9, 8, 7, 6, 5, 4, 3, or 2 days after the previous administration. In one embodiment, more than one administration of cells comprising a CAR molecule are administered to the subject (e.g., human) per week, e.g., 2, 3, or 4 administrations of cells comprising a CAR molecule are administered per week. In one embodiment, the subject (e.g., human subject) receives more than one administration of cells comprising a CAR molecule per week (e.g., 2, 3 or 4 administrations per week) (also referred to herein as a cycle), followed by a week of no administration of cells comprising a CAR molecule and then one or more additional administration of cells comprising a CAR molecule (e.g., more than one administration of the cells comprising a CAR molecule per week) is administered to the subject. In another embodiment, the subject (e.g., human subject) receives more than one cycle of cells comprising a CAR molecule, and the time between each cycle is less than 10, 9, 8, 7, 6, 5, 4, or 3 days. In one embodiment, the cells comprising a CAR molecule are administered every other day for 3 administrations per week. In one embodiment, the cells comprising a CAR molecule are administered for at least two, three, four, five, six, seven, eight or more weeks.

In one embodiment, the cells expressing a CAR molecule are administered as a first line treatment for the disease, e.g., the cancer, e.g., the cancer described herein. In another embodiment, the cells expressing a CAR molecule are administered as a second, third, fourth line treatment for the disease, e.g., the cancer, e.g., the cancer described herein.

In one embodiment, a population of cells described herein is administered.

In another aspect, the invention pertains to the isolated nucleic acid molecule encoding a CAR of the invention, the isolated polypeptide molecule of a CAR of the invention, the vector comprising a CAR of the invention, and the cell comprising a CAR of the invention for use as a medicament.

In another aspect, the invention pertains to a the isolated nucleic acid molecule encoding a CAR of the invention, the isolated polypeptide molecule of a CAR of the invention, the vector comprising a CAR of the invention, and the cell comprising a CAR of the invention for use in the treatment of a disease expressing a cancer associated antigen as described herein.

In another aspect, the invention pertains to a cell expressing a CAR molecule for use as a medicament in combination with a cytokine, e.g., IL-7, IL-15 and/or IL-21 as described herein. In another aspect, the invention pertains to a cytokine described herein for use as a medicament in combination with a cell expressing a CAR molecule described herein.

In another aspect, the invention pertains to a cell expressing a CAR molecule for use as a medicament in combination with a kinase inhibitor and/or a checkpoint inhibitor as described herein. In another aspect, the invention pertains to a kinase inhibitor and/or a checkpoint inhibitor described herein for use as a medicament in combination with a cell expressing a CAR molecule described herein.

In another aspect, the invention pertains to a cell expressing a CAR molecule for use in combination with a cytokine, e.g., IL-7, IL-15 and/or IL-21 as described herein, in the treatment of a disease expressing a tumor antigen targeted by the CAR. In another aspect, the invention pertains to a cytokine described herein for use in combination with a cell expressing a CAR molecule described herein, in the treatment of a disease expressing a tumor antigen targeted by the CAR.

In another aspect, the invention pertains to a cell expressing a CAR molecule for use in combination with a kinase inhibitor and/or a checkpoint inhibitor as described herein, in the treatment of a disease expressing a tumor antigen targeted by the CAR. In another aspect, the invention pertains to a kinase inhibitor and/or a checkpoint inhibitor described herein for use in combination with a cell expressing a CAR molecule described herein, in the treatment of a disease expressing a tumor antigen targeted by the CAR.

In another aspect, the present invention provides a method comprising administering a CAR molecule or a cell comprising a nucleic acid encoding a CAR molecule. In one embodiment, the subject has a disorder described herein, e.g., the subject has cancer, e.g., the subject has a cancer and has tumor-supporting cells which express a tumor-supporting antigen described herein. In one embodiment, the subject is a human.

In another aspect, the invention pertains to a method of treating a subject having a disease associated with expression of a tumor-supporting antigen as described herein comprising administering to the subject an effective amount of a cell comprising a CAR molecule.

In yet another aspect, the invention features a method of treating a subject having a disease associated with expression of a tumor-supporting antigen, comprising administering to the subject an effective amount of a cell, e.g., an immune effector cell (e.g., a population of immune effector cells) comprising a CAR molecule, wherein the CAR molecule comprises an antigen binding domain, a transmembrane domain, and an intracellular domain, said intracellular domain comprises a costimulatory domain and/or a primary signaling domain, wherein said antigen binding domain binds to the tumor-supporting antigen associated with the disease, e.g. a tumor-supporting antigen as described herein.

In a related aspect, the invention features a method of treating a subject having a disease associated with expression of a tumor-supporting antigen. The method comprises administering to the subject an effective amount of a cell, e.g., an immune effector cell (e.g., a population of immune effector cells) comprising a CAR molecule in combination with an agent that increases the efficacy of the immune cell, wherein:

the CAR molecule comprises an antigen binding domain, a transmembrane domain, and an intracellular domain comprising a costimulatory domain and/or a primary signaling domain, wherein said antigen binding domain binds to the tumor-supporting antigen associated with the disease, e.g. a tumor-supporting antigen as disclosed herein; and the agent that increases the efficacy of the immune cell is chosen from one or more of:
a protein phosphatase inhibitor;
a kinase inhibitor;
a cytokine;
an inhibitor of an immune inhibitory molecule; or
an agent that decreases the level or activity of a $T_{REG}$ cell.

In a related aspect, the invention features a method of treating a subject having a disease associated with expression of a tumor-supporting antigen, comprising administering to the subject an effective amount of a cell, e.g., an immune effector cell (e.g., a population of immune effector cells) comprising a CAR molecule:

the CAR molecule comprises an antigen binding domain, a transmembrane domain, and an intracellular domain comprising a costimulatory domain and/or a primary signaling domain, wherein said antigen binding domain binds to the tumor-supporting antigen associated with the disease, e.g., a tumor-supporting antigen as disclosed herein; and the antigen binding domain of the CAR molecule has a binding affinity at least 5-fold less than an antibody from which the antigen binding domain is derived.

In another aspect, the invention features a composition comprising an immune effector cell (e.g., a population of immune effector cells) comprising a CAR molecule for use in the treatment of a subject having a disease associated with expression of a tumor-supporting antigen, e.g., a disorder as described herein.

In any of the aforesaid methods or uses, the disease associated with expression of the tumor-supporting antigen is selected from the group consisting of a proliferative disease, a precancerous condition, a cancer, and a non-cancer related indication associated with expression of the tumor-supporting antigen. In an embodiment, the disease associated with a tumor-supporting antigen described herein is a solid tumor.

In one embodiment of the methods or uses described herein, the CAR molecule is administered in combination with another agent. In one embodiment, the agent can be a kinase inhibitor, e.g., a CDK4/6 inhibitor, a BTK inhibitor, an mTOR inhibitor, a MNK inhibitor, or a dual PI3K/mTOR inhibitor, and combinations thereof. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d] pyrimidine. The MNK inhibitor can be, e.g., a MNK1a, MNK1b, MNK2a and/or MNK2b inhibitor. The dual PI3K/mTOR inhibitor can be, e.g., PF-04695102.

In one embodiment of the methods or uses described herein, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]

oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment of the methods or uses described herein, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment of the methods or uses described herein, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In one embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment of the methods or uses described herein, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment of the methods or uses described herein, the kinase inhibitor is a BTK inhibitor that does not inhibit the kinase activity of ITK, e.g., RN-486, and RN-486 is administered at a dose of about 100 mg, 110 mg, 120 mg, 130 mg, 140 mg, 150 mg, 160 mg, 170 mg, 180 mg, 190 mg, 200 mg, 210 mg, 220 mg, 230 mg, 240 mg, 250 mg (e.g., 150 mg, 200 mg or 250 mg) daily for a period of time, e.g., daily a 28 day cycle. In one embodiment, 1, 2, 3, 4, 5, 6, 7, or more cycles of RN-486 are administered.

In one embodiment of the methods or uses described herein, the kinase inhibitor is an mTOR inhibitor selected from temsirolimus; ridaforolimus (1R,2R,4S)-4-[(2R)-2[(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl)methanol (AZD8055); 2-amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 112), inner salt (SF1126); and XL765.

In one embodiment of the methods or uses described herein, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment of the methods or uses described herein, the kinase inhibitor is an MNK inhibitor selected from CGP052088; 4-amino-3-(p-fluorophenylamino)-pyrazolo [3,4-d]pyrimidine (CGP57380); cercosporamide; ETC-1780445-2; and 4-amino-5-(4-fluoroanilino)-pyrazolo [3,4-d]pyrimidine.

In one embodiment of the methods or uses described herein, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7 (8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl]phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl]phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In one embodiment of the methods or uses described herein, a CAR expressing immune effector cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment of the methods or uses described herein, the CAR molecule is administered in combination with another agent, and the agent is a cytokine. The cytokine can be, e.g., IL-7, IL-15, IL-21, or a combination thereof. In another embodiment, the CAR molecule is administered in combination with a checkpoint inhibitor, e.g., a checkpoint inhibitor described herein. For example, in one embodiment, the check point inhibitor inhibits an inhibitory molecule selected from PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta.

In further aspects, a CAR-expressing cell described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation. peptide vaccine, such as that described in Izumoto et al. 2008 J Neurosurg 108:963-971.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzamab, gemtuzumab, rituximab, ofatumumab, tositumomab, brentuximab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegen), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil Nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

In embodiments, a CAR-expressing cell described herein is administered to a subject in combination with fludarabine, cyclophosphamide, and/or rituximab. In embodiments, a CAR-expressing cell described herein is administered to a subject in combination with fludarabine, cyclophosphamide, and rituximab (FCR). In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the fludarabine is administered at a dosage of about 10-50 mg/m$^2$ (e.g., about 10-15, 15-20, 20-25, 25-30, 30-35, 35-40, 40-45, or 45-50 mg/m$^2$), e.g., intravenously. In embodiments, the cyclophosphamide is administered at a dosage of about 200-300 mg/m$^2$ (e.g., about 200-225, 225-250, 250-275, or 275-300 mg/m$^2$), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with bendamustine and rituximab. In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the bendamustine is administered at a dosage of about 70-110 mg/m2 (e.g., 70-80, 80-90, 90-100, or 100-110 mg/m2), e.g., intravenously. In embodiments, the rituximab is administered at a dosage of about 400-600 mg/m2 (e.g., 400-450, 450-500, 500-550, or 550-600 mg/m$^2$), e.g., intravenously.

In embodiments, a CAR-expressing cell described herein is administered to a subject in combination with rituximab, cyclophosphamide, doxorubicine, vincristine, and/or a corticosteroid (e.g., prednisone). In embodiments, a CAR-expressing cell described herein is administered to a subject in combination with rituximab, cyclophosphamide, doxorubicine, vincristine, and prednisone (R-CHOP). In embodiments, the subject has diffuse large B-cell lymphoma (DLBCL). In embodiments, the subject has nonbulky limited-stage DLBCL (e.g., comprises a tumor having a size/diameter of less than 7 cm). In embodiments, the subject is treated with radiation in combination with the R-CHOP. For example, the subject is administered R-CHOP (e.g., 1-6 cycles, e.g., 1, 2, 3, 4, 5, or 6 cycles of R-CHOP), followed by radiation. In some cases, the subject is administered R-CHOP (e.g., 1-6 cycles, e.g., 1, 2, 3, 4, 5, or 6 cycles of R-CHOP) following radiation.

In embodiments, a CAR-expressing cell described herein is administered to a subject in combination with etoposide, prednisone, vincristine, cyclophosphamide, doxorubicin, and/or rituximab. In embodiments, a CAR-expressing cell described herein is administered to a subject in combination with etoposide, prednisone, vincristine, cyclophosphamide, doxorubicin, and rituximab (EPOCH-R). In embodiments, a CAR-expressing cell described herein is administered to a subject in combination with dose-adjusted EPOCH-R (DA-EPOCH-R). In embodiments, the subject has a B cell lymphoma, e.g., a Myc-rearranged aggressive B cell lymphoma.

In embodiments, a CAR-expressing cell described herein is administered to a subject in combination with rituximab and/or lenalidomide. Lenalidomide ((RS)-3-(4-Amino-1-oxo 1,3-dihydro-2H-isoindol-2-yl)piperidine-2,6-dione) is an immunomodulator. In embodiments, a CAR-expressing cell described herein is administered to a subject in combination with rituximab and lenalidomide. In embodiments, the subject has follicular lymphoma (FL) or mantle cell lymphoma (MCL). In embodiments, the subject has FL and has not previously been treated with a cancer therapy. In embodiments, lenalidomide is administered at a dosage of about 10-20 mg (e.g., 10-15 or 15-20 mg), e.g., daily. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23, 29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 112), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary vinca alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors include bortezomib (Velcade®); carfilzomib (PX-171-007, (S)-4-Methyl-N-((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

In embodiments, a CAR-expressing cell described herein is administered to a subject in combination with brentuximab. Brentuximab is an antibody-drug conjugate of anti-CD30 antibody and monomethyl auristatin E. In embodiments, the subject has Hodgkin's lymphoma (HL), e.g., relapsed or refractory HL. In embodiments, the subject comprises CD30+ HL. In embodiments, the subject has undergone an autologous stem cell transplant (ASCT). In embodiments, the subject has not undergone an ASCT. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In embodiments, a CAR-expressing cell described herein is administered to a subject in combination with brentuximab and dacarbazine or in combination with brentuximab and bendamustine. Dacarbazine is an alkylating agent with a chemical name of 5-(3,3-Dimethyl-1-triazenyl)imidazole-4-carboxamide. Bendamustine is an alkylating agent with a chemical name of 4-[5-[Bis(2-chloroethyl)amino]-1-methylbenzimidazol-2-yl]butanoic acid. In embodiments, the subject has Hodgkin's lymphoma (HL). In embodiments, the subject has not previously been treated with a cancer therapy. In embodiments, the subject is at least 60 years of age, e.g., 60, 65, 70, 75, 80, 85, or older. In embodiments, dacarbazine is administered at a dosage of about 300-450 mg/m$^2$ (e.g., about 300-325, 325-350, 350-375, 375-400, 400-425, or 425-450 mg/m$^2$), e.g., intravenously. In embodiments, bendamustine is administered at a dosage of about 75-125 mg/m2 (e.g., 75-100 or 100-125 mg/m$^2$, e.g., about 90 mg/m$^2$), e.g., intravenously. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In some embodiments, a CAR-expressing cell described herein is administered to a subject in combination with a CD20 inhibitor, e.g., an anti-CD20 antibody (e.g., an anti-CD20 mono- or bispecific antibody) or a fragment thereof. Exemplary anti-CD20 antibodies include but are not limited to rituximab, ofatumumab, ocrelizumab, veltuzumab, obinutuzumab, TRU-015 (Trubion Pharmaceuticals), ocaratuzumab, and Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2010/103705s5311lbl.pdf. In embodiments, a CAR-expressing cell described herein is administered to a subject in combination with rituximab. In embodiments, the subject has CLL or SLL.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab. In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject. In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more. In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some embodiments, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NSO). See, e.g., www.accessdata.fda.gov/drugsatfda_docs/label/2009/125326lbl.pdf; and Clinical Trial Identifier number NCT01363128, NCT01515176, NCT01626352, and NCT01397591. In embodiments, a CAR-expressing cell described herein is administered to a subject in combination with ofatumumab. In embodiments, the subject has CLL or SLL.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab. In embodiments, ofatumumab is administered at a starting dosage of about 300 mg, followed by 2000 mg, e.g., for about 11 doses, e.g., for 24 weeks. In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some cases, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87.

In some cases, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55.

In some cases, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6(2009):588-96; Clinical Trial Identifier Numbers: NCT01995669, NCT01889797, NCT02229422, and NCT01414205; and www.accessdata.fda.gov/drugsatfda_docs/label/2013/125486s000lbl.pdf.

In some cases, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25; and Forero-Torres et al. Clin Cancer Res. 18.5(2012):1395-403.

In some cases, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46; and Clinical Trial Identifier No. NCT00452127.

In some cases, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1(2011):13-25. TRU-015 contains an anti-CD20 single-chain variable fragment (scFv) linked to human IgG1 hinge, CH2, and CH3 domains but lacks CH1 and CL domains.

In some embodiments, an anti-CD20 antibody described herein is conjugated or otherwise bound to a therapeutic agent, e.g., a chemotherapeutic agent (e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent), anti-allergic agent, anti-nausea agent (or anti-emetic), pain reliever, or cytoprotective agent described herein.

In embodiments, a CAR-expressing cell described herein is administered to a subject in combination with a B-cell lymphoma 2 (BCL-2) inhibitor (e.g., venetoclax, also called ABT-199 or GDC-0199;) and/or rituximab. In embodiments, a CAR-expressing cell described herein is administered to a subject in combination with venetoclax and rituximab. Venetoclax is a small molecule that inhibits the anti-apoptotic protein, BCL-2. The structure of venetoclax (4-(4-{[2-(4-chlorophenyl)-4,4-dimethylcyclohex-1-en-1-yl]methyl}piperazin-1-yl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide) is shown below.

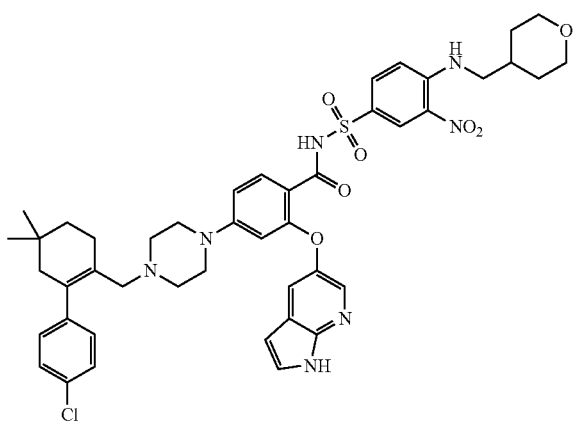 [SMILES: CC1(C)CCC(CN2CCN(c3ccc(C(=O)NS(=O)(=O)c4ccc(NCC5CCOCC5)c([N+](=O)[O-])c4)c(Oc4cnc5[nH]ccc5c4)c3)CC2)=C(c2ccc(Cl)cc2)C1]

In embodiments, the subject has CLL. In embodiments, the subject has relapsed CLL, e.g., the subject has previously been administered a cancer therapy. In embodiments, venetoclax is administered at a dosage of about 15-600 mg (e.g., 15-20, 20-50, 50-75, 75-100, 100-200, 200-300, 300-400, 400-500, or 500-600 mg), e.g., daily. In embodiments, rituximab is administered at a dosage of about 350-550 mg/m2 (e.g., 350-375, 375-400, 400-425, 425-450, 450-475, or 475-500 mg/m2), e.g., intravenously, e.g., monthly In an embodiment, cells expressing a CAR described herein are administered to a subject in combination with a molecule that decreases the Treg cell population. Methods that decrease the number of (e.g., deplete) Treg cells are known in the art and include, e.g., CD25 depletion, cyclophosphamide administration, modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse. In one embodiment, cells expressing a CAR described herein are administered to a subject in combination with a molecule targeting GITR and/or modulating GITR functions, such as a GITR agonist and/or a GITR antibody that depletes regulatory T cells (Tregs). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to apheresis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In an embodiment, the subject has CLL. In embodiments, the subject has ALL. In embodiments, the subject has a solid cancer, e.g., a solid cancer described herein. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with an mTOR inhibitor, e.g., an mTOR inhibitor described herein, e.g., a rapalog such as everolimus. In one embodiment, the mTOR inhibitor is administered prior to the CAR-expressing cell. For example, in one embodiment, the mTOR inhibitor can be administered prior to apheresis of the cells. In one embodiment, the subject has CLL.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells. In one embodiment, the subject has CLL.

In one embodiment, a CAR-expressing cell described herein can be used in combination with a kinase inhibitor. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor. In one embodiment, the kinase inhibitor is a dual PI3K/mTOR inhibitor described herein, such as, e.g., PF-04695102.

In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2- amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In embodiments, a CAR-expressing cell described herein is administered to a subject in combination with a cyclin-dependent kinase (CDK) 4 or 6 inhibitor, e.g., a CDK4 inhibitor or a CDK6 inhibitor described herein. In embodiments, a CAR-expressing cell described herein is administered to a subject in combination with a CDK4/6 inhibitor (e.g., an inhibitor that targets both CDK4 and CDK6), e.g., a CDK4/6 inhibitor described herein. In an embodiment, the subject has MCL. MCL is an aggressive cancer that is poorly responsive to currently available therapies, i.e., essentially incurable. In many cases of MCL, cyclin D1 (a regulator of CDK4/6) is expressed (e.g., due to chromosomal translocation involving immunoglobulin and Cyclin D1 genes) in MCL cells. Thus, without being bound by theory, it is thought that MCL cells are highly sensitive to CDK4/6 inhibition with high specificity (i.e., minimal effect on normal immune cells). CDK4/6 inhibitors alone have had some efficacy in treating MCL, but have only achieved partial remission with a high relapse rate. An exemplary CDK4/6 inhibitor is LEE011 (also called ribociclib), the structure of which is shown below.

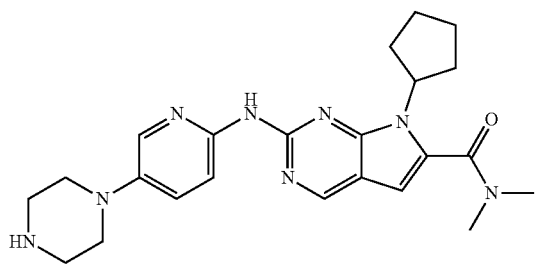 [SMILES: CN(C)C(=O)c1cc2cnc(Nc3ccc(N4CCNCC4)cn3)nc2n1C1CCCC1]

Without being bound by theory, it is believed that administration of a CAR-expressing cell described herein with a CDK4/6 inhibitor (e.g., LEE011 or other CDK4/6 inhibitor described herein) can achieve higher responsiveness, e.g., with higher remission rates and/or lower relapse rates, e.g., compared to a CDK4/6 inhibitor alone.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In a preferred embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In embodiments, a CAR-expressing cell described herein is administered to a subject in combination with a BTK inhibitor (e.g., ibrutinib). In embodiments, a CAR-expressing cell described herein is administered to a subject in combination with ibrutinib (also called PCI-32765). The structure of ibrutinib (1-[(3R)-3-[4-Amino-3-(4-phenoxyphenyl)-1H-pyrazolo[3,4-d]pyrimidin-1-yl]piperidin-1-yl]prop-2-en-1-one) is shown below.

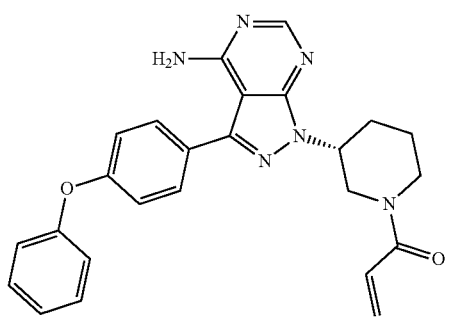 [SMILES: C=CC(=O)N1CCC[C@@H](n2nc(-c3ccc(Oc4ccccc4)cc3)c3c(N)ncnc32)C1]

In embodiments, the subject has CLL, mantle cell lymphoma (MCL), or small lymphocytic lymphoma (SLL). For example, the subject has a deletion in the short arm of chromosome 17 (del(17p), e.g., in a leukemic cell). In other examples, the subject does not have a del(17p). In embodiments, the subject has relapsed CLL or SLL, e.g., the subject has previously been administered a cancer therapy (e.g., previously been administered one, two, three, or four prior cancer therapies). In embodiments, the subject has refractory CLL or SLL. In other embodiments, the subject has follicular lymphoma, e.g., relapse or refractory follicular lymphoma. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered. Without being bound by theory, it is thought that the addition of ibrutinib enhances the T cell proliferative response and may shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses.

In one embodiment, the kinase inhibitor is an mTOR inhibitor selected from temsirolimus; ridaforolimus (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$]hexatriaconta-16,24,26,28-tetraen-12-yl]propyl]-2- methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-amino-8-[trans-4-(2-hydroxyethoxy)cyclohexyl]-6-(6-methoxy-3-pyridinyl)-4-methylpyrido[2,3-d]pyrimidin-7(8H)-one (PF04691502); and $N^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 112), inner salt (SF1126); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo[3,4-d]pyrimidine (CGP57380); cercosporamide; ETC-1780445-2; and 4-amino-5-(4-fluoroanilino)-pyrazolo[3,4-d]pyrimidine.

In embodiments, a CAR-expressing cell described herein is administered to a subject in combination with a phosphoinositide 3-kinase (PI3K) inhibitor (e.g., a PI3K inhibitor described herein, e.g., idelalisib or duvelisib) and/or rituximab. In embodiments, a CAR-expressing cell described herein is administered to a subject in combination with idelalisib and rituximab. In embodiments, a CAR-expressing cell described herein is administered to a subject in combination with duvelisib and rituximab. Idelalisib (also called GS-1101 or CAL-101; Gilead) is a small molecule that blocks the delta isoform of PI3K. The structure of idelalisib (5-Fluoro-3-phenyl-2-[(1S)-1-(7H-purin-6-ylamino)propyl]-4(3H)-quinazolinone) is shown below.

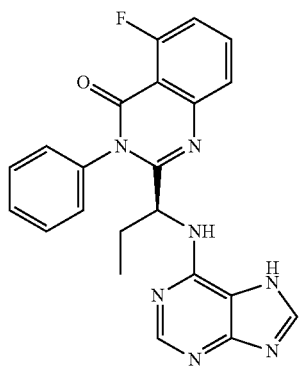 [SMILES: CC[C@H](Nc1ncnc2nc[nH]c12)c1nc2cccc(F)c2c(=O)n1-c1ccccc1]

Duvelisib (also called IPI-145; Infinity Pharmaceuticals and Abbvie) is a small molecule that blocks PI3K-δ,γ. The structure of duvelisib (8-Chloro-2-phenyl-3-[(1S)-1-(9H-purin-6-ylamino)ethyl]-1(2H)-isoquinolinone) is shown below.

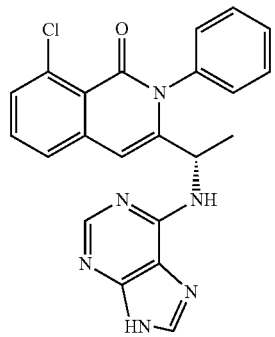 [SMILES: C[C@H](Nc1ncnc2[nH]cnc12)c1cc2cccc(Cl)c2c(=O)n1-c1ccccc1]

In embodiments, the subject has CLL. In embodiments, the subject has relapsed CLL, e.g., the subject has previously been administered a cancer therapy (e.g., previously been administered an anti-CD20 antibody or previously been administered ibrutinib). For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the subject has a deletion in the long arm of chromosome 11 (del(11q)). In other embodiments, the subject does not have a del(11q). In embodiments, idelalisib is administered at a dosage of about 100-400 mg (e.g., 100-125, 125-150, 150-175, 175-200, 200-225, 225-250, 250-275, 275-300, 325-350, 350-375, or 375-400 mg), e.g., BID. In embodiments, duvelisib is administered at a dosage of about 15-100 mg (e.g., about 15-25, 25-50, 50-75, or 75-100 mg), e.g., twice a day. In embodiments, rituximab is administered at a dosage of about 350-550 mg/m² (e.g., 350-375, 375-400, 400-425, 425-450, 450-475, or 475-500 mg/m²), e.g., intravenously.

In one embodiment, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl] phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl] phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In embodiments, a CAR-expressing cell described herein is administered to a subject in combination with an anaplastic lymphoma kinase (ALK) inhibitor. Exemplary ALK kinases include but are not limited to crizotinib (Pfizer), ceritinib (Novartis), alectinib (Chugai), brigatinib (also called AP26113; Ariad), entrectinib (Ignyta), PF-06463922 (Pfizer), TSR-011 (Tesaro) (see, e.g., Clinical Trial Identifier No. NCT02048488), CEP-37440 (Teva), and X-396 (Xcovery). In some embodiments, the subject has a solid cancer, e.g., a solid cancer described herein, e.g., lung cancer.

The chemical name of crizotinib is 3-[(1R)-1-(2,6-dichloro-3-fluorophenyl)ethoxy]-5-(1-piperidin-4-ylpyrazol-4-yl)pyridin-2-amine. The chemical name of ceritinib is 5-Chloro-$N^2$-[2-isopropoxy-5-methyl-4-(4-piperidinyl)phenyl]-$N^4$-[2-(isopropylsulfonyl)phenyl]-2,4-pyrimidinediamine. The chemical name of alectinib is 9-ethyl-6,6-dimethyl-8-(4-morpholinopiperidin-1-yl)-11-oxo-6,11-dihydro-5H-benzo[b]carbazole-3-carbonitrile. The chemical name of brigatinib is 5-Chloro-$N^2$-{4-[4-(dimethylamino)-1-piperidinyl]-2-methoxyphenyl}-$N^4$-[2-(dimethylphosphoryl)phenyl]-2,4-pyrimidinediamine. The chemical name of entrectinib is N-(5-(3,5-difluorobenzyl)-1H-indazol-3-yl)-4-(4-methylpiperazin-1-yl)-2-((tetrahydro-2H-pyran-4-yl)amino)benzamide. The chemical name of PF-06463922 is (10R)-7-Amino-12-fluoro-2,10,16-trimethyl-15-oxo-10,15,16,17-tetrahydro-2H-8,4-(metheno)pyrazolo[4,3-h][2,5,11]-benzoxadiazacyclotetradecine-3-carbonitrile. The chemical structure of CEP-37440 is (S)-2-((5-chloro-2-((6-(4-(2-hydroxyethyl)piperazin-1-yl)-1-methoxy-6,7,8,9-tetrahydro-5H-benzo[7]annulen-2-yl)amino)pyrimidin-4-yl)amino)-N-methylbenzamide. The chemical name of X-396 is (R)-6-amino-5-(1-(2,6-dichloro-3-fluorophenyl)ethoxy)-N-(4-(4-methylpiperazine-1-carbonyl)phenyl)pyridazine-3-carboxamide.

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun 73:316-321, 1991; Bierer et al., Curr. Opin. Immun 5:763-773, 1993) can also be used. In a further aspect, the cell compositions of the present invention may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

In embodiments, a CAR-expressing cell described herein is administered to a subject in combination with an indoleamine 2,3-dioxygenase (IDO) inhibitor. IDO is an enzyme that catalyzes the degradation of the amino acid, L-tryptophan, to kynurenine. Many cancers overexpress IDO, e.g., prostatic, colorectal, pancreatic, cervical, gastric, ovarian, head, and lung cancer. pDCs, macrophages, and dendritic cells (DCs) can express IDO. Without being bound by theory, it is thought that a decrease in L-tryptophan (e.g., catalyzed by IDO) results in an immunosuppressive milieu by inducing T-cell anergy and apoptosis. Thus, without being bound by theory, it is thought that an IDO inhibitor can enhance the efficacy of a CAR-expressing cell described herein, e.g., by decreasing the suppression or death of a CAR-expressing immune cell. In embodiments, the subject has a solid tumor, e.g., a solid tumor described herein, e.g., prostatic, pancreatic, cervical, gastric, ovarian, head, or lung cancer. Exemplary inhibitors of IDO include but are not limited to 1-methyl-tryptophan, indoximod (NewLink Genetics) (see, e.g., Clinical Trial Identifier Nos. NCT01191216; NCT01792050), and INCB024360 (Incyte Corp.) (see, e.g., Clinical Trial Identifier Nos. NCT01604889; NCT01685255).

In embodiments, a CAR-expressing cell described herein is administered to a subject in combination with a modulator of myeloid-derived suppressor cells (MDSCs). MDSCs accumulate in the periphery and at the tumor site of many solid tumors. These cells suppress T cell responses, thereby hindering the efficacy of CAR-expressing cell therapy. Without being bound by theory, it is thought that administration of a MDSC modulator enhances the efficacy of a CAR-expressing cell described herein. In an embodiment, the subject has a solid tumor, e.g., a solid tumor described herein, e.g., glioblastoma. Exemplary modulators of MDSCs include but are not limited to MCS110 and BLZ945. MCS110 is a monoclonal antibody (mAb) against macrophage colony-stimulating factor (M-CSF). See, e.g., Clinical Trial Identifier No. NCT00757757. BLZ945 is a small molecule inhibitor of colony stimulating factor 1 receptor (CSF1R). See, e.g., Pyonteck et al. Nat. Med. 19(2013): 1264-72. The structure of BLZ945 is shown below.

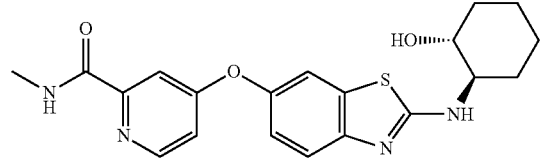 [SMILES: CNC(=O)c1cc(Oc2ccc3nc(N[C@@H]4CCCC[C@H]4O)sc3c2)ccn1]

In embodiments, a CAR-expressing cell described herein is administered to a subject in combination with a CD19 CART cell (e.g., CTL019, e.g., as described in WO2012/079000, incorporated herein by reference). In embodiments, the subject has a CD19+ lymphoma, e.g., a CD19+ Non-Hodgkin's Lymphoma (NHL), a CD19+ FL, or a CD19+ DLBCL. In embodiments, the subject has a relapsed or refractory CD19+ lymphoma. In embodiments, a lymphodepleting chemotherapy is administered to the subject prior to, concurrently with, or after administration (e.g., infusion) of CD19 CART cells. In an example, the lymphodepleting chemotherapy is administered to the subject prior to administration of CD19 CART cells. For example, the lymphodepleting chemotherapy ends 1-4 days (e.g., 1, 2, 3, or 4 days) prior to CD19 CART cell infusion. In embodiments, multiple doses of CD19 CART cells are administered, e.g., as described herein. For example, a single dose comprises about $5 \times 10^8$ CD19 CART cells. In embodiments, a lymphodepleting chemotherapy is administered to the subject prior to, concurrently with, or after administration (e.g., infusion) of a CAR-expressing cell described herein, e.g., a non-CD19 CAR-expressing cell. In embodiments, a CD19 CART is administered to the subject prior to, concurrently with, or after administration (e.g., infusion) of a non-CD19 CAR-expressing cell, e.g., a non-CD19 CAR-expressing cell described herein.

In some embodiments, a CAR-expressing cell described herein is administered to a subject in combination with a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15 (Admune Therapeutics, LLC). hetIL-15 is a heterodimeric non-covalent complex of IL-15 and IL-15Ra. hetIL-15 is described in, e.g., U.S. Pat. No. 8,124,084, U.S. 2012/

0177598, U.S. 2009/0082299, U.S. 2012/0141413, and U.S. 2011/0081311, incorporated herein by reference. In embodiments, het-IL-15 is administered subcutaneously. In embodiments, the subject has a cancer, e.g., solid cancer, e.g., melanoma or colon cancer. In embodiments, the subject has a metastatic cancer.

In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. CRS may include clinical constitutional signs and symptoms such as fever, fatigue, anorexia, myalgias, arthalgias, nausea, vomiting, and headache. CRS may include clinical skin signs and symptoms such as rash. CRS may include clinical gastrointestinal signs and symptoms such as nausea, vomiting and diarrhea. CRS may include clinical respiratory signs and symptoms such as tachypnea and hypoxemia. CRS may include clinical cardiovascular signs and symptoms such as tachycardia, widened pulse pressure, hypotension, increased cardiac output (early) and potentially diminished cardiac output (late). CRS may include clinical coagulation signs and symptoms such as elevated d-dimer, hypofibrinogenemia with or without bleeding. CRS may include clinical renal signs and symptoms such as azotemia. CRS may include clinical hepatic signs and symptoms such as transaminitis and hyperbilirubinemia. CRS may include clinical neurologic signs and symptoms such as headache, mental status changes, confusion, delirium, word finding difficulty or frank aphasia, hallucinations, tremor, dymetria, altered gait, and seizures.

Accordingly, the methods described herein can comprise administering a CAR-expressing cell described herein to a subject and further administering one or more agents to manage elevated levels of a soluble factor resulting from treatment with a CAR-expressing cell. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitors of TNFα include, but are not limited to, xanthine derivatives (e.g. pentoxifylline) and bupropion. An example of an IL-6 inhibitor is an anti-IL-6 antibody molecule or an anti-IL-6 receptor antibody molecule such as tocilizumab (toc), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 receptor antibody molecule is tocilizumab. An example of an IL-1R based inhibitor is anakinra.

In one embodiment, the subject can be administered an agent which enhances the activity of a CAR-expressing cell. For example, in one embodiment, the agent can be an agent which inhibits an inhibitory molecule. Inhibitory molecules, e.g., Programmed Death 1 (PD-1), can, in some embodiments, decrease the ability of a CAR-expressing cell to mount an immune effector response. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR. In one embodiment, the inhibitor of an inhibitory signal can be, e.g., an antibody or antibody fragment that binds to an inhibitory molecule. For example, the agent can be an antibody or antibody fragment that binds to PD-1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206)). In an embodiment, the agent is an antibody or antibody fragment that binds to TIM3. In an embodiment, the agent is an antibody or antibody fragment that binds to CEACAM (CEACAM-1, CEACAM-3, and/or CEACAM-5). In an embodiment, the agent is an antibody or antibody fragment that binds to LAG3.

PD-1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD-1, PD-L1 and PD-L2 have been shown to downregulate T cell activation upon binding to PD-1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094) Immune suppression can be reversed by inhibiting the local interaction of PD-1 with PD-L1. Antibodies, antibody fragments, and other inhibitors of PD-1, PD-L1 and PD-L2 are available in the art and may be used combination with a cars of the present invention described herein. For example, nivolumab (also referred to as BMS-936558 or MDX1106; Bristol-Myers Squibb) is a fully human IgG4 monoclonal antibody which specifically blocks PD-1. Nivolumab (clone 5C4) and other human monoclonal antibodies that specifically bind to PD-1 are disclosed in U.S. Pat. No. 8,008,449 and WO2006/121168. Pidilizumab (CT-011; Cure Tech) is a humanized IgG1k monoclonal antibody that binds to PD-1. Pidilizumab and other humanized anti-PD-1 monoclonal antibodies are disclosed in WO2009/101611. Pembrolizumab (formerly known as lambrolizumab, and also referred to as MK03475; Merck) is a humanized IgG4 monoclonal antibody that binds to PD-1. Pembrolizumab and other humanized anti-PD-1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S. Publication No.: 20120039906. Other anti-PD-L1 binding agents include YW243.55.S70 (heavy and light chain variable regions are shown in SEQ ID NOs 20 and 21 in WO2010/077634) and MDX-1105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD-1 and B7-H1. Other anti-PD-1 antibodies include AMP 514 (Amplimmune), among others, e.g., anti-PD-1 antibodies disclosed in U.S. Pat. No. 8,609,089, US 2010028330, and/or US 20120114649.

TIM-3 (T cell immunoglobulin-3) also negatively regulates T cell function, particularly in IFN-g-secreting CD4+ T helper 1 and CD8+ T cytotoxic 1 cells, and plays a critical role in T cell exhaustion. Inhibition of the interaction between TIM3 and its ligands, e.g., galectin-9 (Gal9), phosphotidylserine (PS), and HMGB1, can increase immune response. Antibodies, antibody fragments, and other inhibitors of TIM3 and its ligands are available in the art and may be used combination with a CD19 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In other embodiments, the agent that enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. *PLoS One.* 2010 Sep. 2; 5(9). pii: e12529 (DOI:10:1371/journal-.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. *J Immunol.* 2002 Mar. 15; 168(6): 2803-10; Markel et al. *J Immunol.* 2006 Nov. 1; 177(9): 6062-71; Markel et al. *Immunology.* 2009 February; 126(2): 186-200; Markel et al. *Cancer Immunol Immunother.* 2010 February; 59(2):215-30; Ortenberg et al. *Mol Cancer Ther.* 2012 June; 11(6):1300-10; Stern et al. *J Immunol.* 2005 Jun. 1; 174(11):6692-701; Zheng et al. *PLoS One.* 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) *Nature* doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG-3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG-3 and its ligands are available in the art and may be used combination with a CD19 CAR described herein. For example, BMS-986016 (Bristol-Myers Squib) is a monoclonal antibody that targets LAG3. IMP701 (Immutep) is an antagonist LAG-3 antibody and IMP731 (Immutep and GlaxoSmithKline) is a depleting LAG-3 antibody. Other LAG-3 inhibitors include IMP321 (Immutep), which is a recombinant fusion protein of a soluble portion of LAG3 and Ig that binds to MHC class II molecules and activates antigen presenting cells (APC). Other antibodies are disclosed, e.g., in WO2010/019570.

In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an intracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell that does not express a CAR of the present invention.

In one embodiment, the agent which enhances activity of a CAR-expressing cell described herein is miR-17-92.

In one embodiment, the agent which enhances activity of a CAR-described herein is a cytokine. Cytokines have important functions related to T cell expansion, differentiation, survival, and homeostasis. Cytokines that can be administered to the subject receiving a CAR-expressing cell described herein include: IL-2, IL-4, IL-7, IL-9, IL-15, IL-18, and IL-21, or a combination thereof. In preferred embodiments, the cytokine administered is IL-7, IL-15, or IL-21, or a combination thereof. The cytokine can be administered once a day or more than once a day, e.g., twice a day, three times a day, or four times a day. The cytokine can be administered for more than one day, e.g. the cytokine is administered for 2 days, 3 days, 4 days, 5 days, 6 days, 1 week, 2 weeks, 3 weeks, or 4 weeks. For example, the cytokine is administered once a day for 7 days.

In embodiments, the cytokine is administered in combination with CAR-expressing T cells. The cytokine can be administered simultaneously or concurrently with the CAR-expressing T cells, e.g., administered on the same day. The cytokine may be prepared in the same pharmaceutical composition as the CAR-expressing T cells, or may be prepared in a separate pharmaceutical composition. Alternatively, the cytokine can be administered shortly after administration of the CAR-expressing T cells, e.g., 1 day, 2 days, 3 days, 4 days, 5 days, 6 days, or 7 days after administration of the CAR-expressing T cells. In embodiments where the cytokine is administered in a dosing regimen that occurs over more than one day, the first day of the cytokine dosing regimen can be on the same day as administration with the CAR-expressing T cells, or the first day of the cytokine dosing regimen can be 1 day, 2 days, 3 days, 4 days, 5 days, 6 days, or 7 days after administration of the CAR-expressing T cells. In one embodiment, on the first day, the CAR-expressing T cells are administered to the subject, and on the second day, a cytokine is administered once a day for the next 7 days. In a preferred embodiment, the cytokine to be administered in combination with CAR-expressing T cells is IL-7, IL-15, or IL-21.

In other embodiments, the cytokine is administered a period of time after administration of CAR-expressing cells, e.g., at least 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells. In one embodiment, the cytokine is administered after assessment of the subject's response to the CAR-expressing cells. For example, the subject is administered CAR-expressing cells according to the dosage and regimens described herein. The response of the subject to CAR-expressing cell therapy is assessed at 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells, using any of the methods described herein, including inhibition of tumor growth, reduction of circulating tumor cells, or tumor regression. Subjects that do not exhibit a sufficient response to CAR-expressing cell therapy can be administered a cytokine. Administration of the cytokine to the subject that has sub-optimal response to the CAR-expressing cell therapy improves CAR-expressing cell efficacy or anti-cancer activity. In a preferred embodiment, the cytokine administered after administration of CAR-expressing cells is IL-7.

Combination with a Low Dose of an mTOR Inhibitor

In one embodiment, the cells expressing a CAR molecule, e.g., a CAR molecule described herein, are administered in combination with a low, immune enhancing dose of an mTOR inhibitor.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, or at least 70 but no more than 90%.

In an embodiment, a dose of an mTOR inhibitor is associated with, or provides, mTOR inhibition of at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, or at least 60 but no more than 80%.

In an embodiment, a dose of an mTOR inhibitor is associated with, or provides, mTOR inhibition of at least 5 but no more than 70%, at least 10 but no more than 70%, at least 15, but no more than 70%, at least 20 but no more than 70%, at least 30 but no more than 70%, at least 40 but no more than 70%, or at least 50 but no more than 70%.

In an embodiment, a dose of an mTOR inhibitor is associated with, or provides, mTOR inhibition of at least 5 but no more than 60%, at least 10 but no more than 60%, at least 15, but no more than 60%, at least 20 but no more than 60%, at least 30 but no more than 60%, or at least 40 but no more than 60%.

In an embodiment, a dose of an mTOR inhibitor is associated with, or provides, mTOR inhibition of at least 5 but no more than 50%, at least 10 but no more than 50%, at least 15, but no more than 50%, at least 20 but no more than 50%, at least 30 but no more than 50%, or at least 40 but no more than 50%.

In an embodiment, a dose of an mTOR inhibitor is associated with, or provides, mTOR inhibition of at least 5 but no more than 40%, at least 10 but no more than 40%, at least 15, but no more than 40%, at least 20 but no more than 40%, at least 30 but no more than 40%, or at least 35 but no more than 40%.

In an embodiment, a dose of an mTOR inhibitor is associated with, or provides, mTOR inhibition of at least 5 but no more than 30%, at least 10 but no more than 30%, at least 15, but no more than 30%, at least 20 but no more than 30%, or at least 25 but no more than 30%.

In an embodiment, a dose of an mTOR inhibitor is associated with, or provides, mTOR inhibition of at least 1, 2, 3, 4 or 5 but no more than 20%, at least 1, 2, 3, 4 or 5 but no more than 30%, at least 1, 2, 3, 4 or 5, but no more than 35, at least 1, 2, 3, 4 or 5 but no more than 40%, or at least 1, 2, 3, 4 or 5 but no more than 45%.

In an embodiment, a dose of an mTOR inhibitor is associated with, or provides, mTOR inhibition of at least 1, 2, 3, 4 or 5 but no more than 90%.

As is discussed herein, the extent of mTOR inhibition can be expressed as the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by a method described herein, e.g. by the Boulay assay, or measurement of phosphorylated S6 levels by western blot.

Exemplary mTOR Inhibitors

As used herein, the term "mTOR inhibitor" refers to a compound or ligand, or a pharmaceutically acceptable salt thereof, which inhibits the mTOR kinase in a cell. In an embodiment an mTOR inhibitor is an allosteric inhibitor. In an embodiment an mTOR inhibitor is a catalytic inhibitor.

Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity.

Rapamycin is a known macrolide antibiotic produced by *Streptomyces hygroscopicus* having the structure shown in Formula A.

(A)

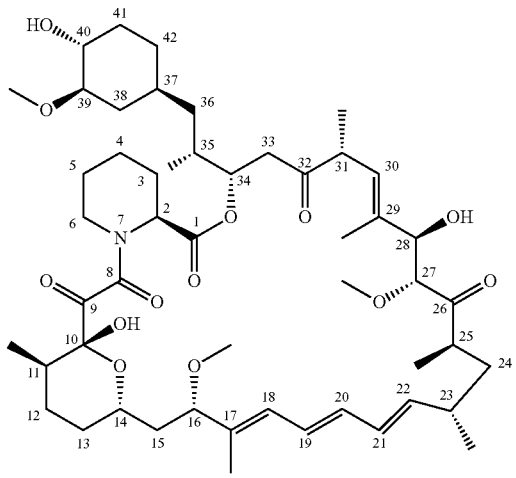

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, O-substituted analogs in which the hydroxyl group on the cyclohexyl ring of rapamycin is replaced by $OR_1$ in which $R_1$ is hydroxyalkyl, hydroxyalkoxyalkyl, acylaminoalkyl, or aminoalkyl; e.g. RAD001, also known as, everolimus as described in U.S. Pat. No. 5,665,772 and WO94/09010 the contents of which are incorporated by reference. Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E,4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2-acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2-aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethyl)-rapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. Pat. No. RE44,768, e.g. temsirolimus.

Other rapamycin analogs useful in the preset invention include those wherein the methoxy group at the 16 position is replaced with another substituent, preferably (optionally hydroxy-substituted) alkynyloxy, benzyl, orthomethoxybenzyl or chlorobenzyl and/or wherein the mexthoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807 the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demthoxy-16-(pent-2-ynyl)oxy-rapamycin, 16-demthoxy-16-(but-2-ynyl)oxy-rapamycin, 16-demthoxy-16-(propargyl)oxy-rapamycin, 16-demethoxy-16-(4-hydroxy-but-2-ynyl)oxy-rapamycin, 16-demthoxy-16-benzyloxy-40-O-(2-hydroxyethyl)-rapamycin, 16-demthoxy-16-benzyloxy-rapamycin, 16-demethoxy-16-ortho-methoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methyl-piperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl, N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (Afinitor®), has the chemical name (1R,9S,12S,15R,16E,18R,19R,21R, 23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29, 35-hexamethyl-11,36-dioxa-4-aza-tricyclo[30.3.1.04,9] hexatriaconta-16,24,26,28-tetraene-2,3,10,14,20-pentaone Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibtors include zotarolimus (ABT578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]quinolin-1-yl)-phenyl]-propionitrile, or the monotosylate salt form the synthesis of BEZ235 is described in WO2006/122806; CCG168 (otherwise known as AZD-8055, Chresta, C. M., et al., Cancer Res, 2010, 70(1), 288-298) which has the chemical name {5-[2,4-bis-((S)-3-methyl-morpholin-4-yl)-pyrido[2,3d]pyrimidin-7-yl]-2-methoxy-phenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl)sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl}benzenesulfonamide; 5-(9-isopropyl-8-methyl-2-morpholino-9H-purin-6-yl)pyrimidin-2-amine (WO10114484); (E)-N-(8-(6-amino-5-(trifluoromethyl)pyridin-3-yl)-1-(6-(2-cyanopropan-2-yl)pyridin-3-yl)-3-methyl-1H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTor inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing.

mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Evaluation of mTOR Inhibition mTOR phosphorylates the kinase P70 S6, thereby activating P70 S6 kinase and allowing it to phosphorylate its substrate. The extent of mTOR inhibition can be expressed as the extent of P70 S6 kinase inhibition, e.g., the extent of mTOR inhibition can be determined by the level of decrease in P70 S6 kinase activity, e.g., by the decrease in phosphorylation of a P70 S6 kinase substrate. One can determine the level of mTOR inhibition, by measuring P70 S6 kinase activity (the ability of P70 S6 kinase to phosphorylate a substrate), in the absence of inhibitor, e.g., prior to administration of inhibitor, and in the presences of inhibitor, or after the administration of inhibitor. The level of inhibition of P70 S6 kinase gives the level of mTOR inhibition. Thus, if P70 S6 kinase is inhibited by 40%, mTOR activity, as measured by P70 S6 kinase activity, is inhibited by 40%. The extent or level of inhibition referred to herein is the average level of inhibition over the dosage interval. By way of example, if the inhibitor is given once per week, the level of inhibition is given by the average level of inhibition over that interval, namely a week.

Boulay et al., Cancer Res, 2004, 64:252-61, hereby incorporated by reference, teaches an assay that can be used to assess the level of mTOR inhibition (referred to herein as the Boulay assay). In an embodiment, the assay relies on the measurement of P70 S6 kinase activity from biological samples before and after administration of an mTOR inhibitor, e.g., RAD001. Samples can be taken at preselected times after treatment with an mTOR inhibitor, e.g., 24, 48, and 72 hours after treatment. Biological samples, e.g., from skin or peripheral blood mononuclear cells (PBMCs) can be used. Total protein extracts are prepared from the samples. P70 S6 kinase is isolated from the protein extracts by immunoprecipitation using an antibody that specifically recognizes the P70 S6 kinase. Activity of the isolated P70 S6 kinase can be measured in an in vitro kinase assay. The isolated kinase can be incubated with 40S ribosomal subunit substrates (which is an endogenous substrate of P70 S6 kinase) and gamma-$^{32}$P under conditions that allow phosphorylation of the substrate. Then the reaction mixture can be resolved on an SDS-PAGE gel, and $^{32}$P signal analyzed using a PhosphorImager. A $^{32}$P signal corresponding to the size of the 40S ribosomal subunit indicates phosphorylated substrate and the activity of P70 S6 kinase. Increases and decreases in kinase activity can be calculated by quantifying the area and intensity of the $^{32}$P signal of the phosphorylated substrate (e.g., using ImageQuant, Molecular Dynamics), assigning arbitrary unit values to the quantified signal, and comparing the values from after administration with values from before administration or with a reference value. For example, percent inhibition of kinase activity can be calculated with the following formula: 1−(value obtained after administration/value obtained before administration)×100. As described above, the extent or level of inhibition referred to herein is the average level of inhibition over the dosage interval.

Methods for the evaluation of kinase activity, e.g., P70 S6 kinase activity, are also provided in U.S. Pat. No. 7,727,950, hereby incorporated by reference.

The level of mTOR inhibition can also be evaluated by a change in the ration of PD1 negative to PD1 positive T cells. T cells from peripheral blood can be identified as PD1 negative or positive by art-known methods.

Low-Dose mTOR Inhibitors

Methods described herein use low, immune enhancing, dose mTOR inhibitors, doses of mTOR inhibitors, e.g., allosteric mTOR inhibitors, including rapalogs such as RAD001. In contrast, levels of inhibitor that fully or near fully inhibit the mTOR pathway are immunosuppressive and are used, e.g., to prevent organ transplant rejection. In addition, high doses of rapalogs that fully inhibit mTOR also inhibit tumor cell growth and are used to treat a variety of cancers (See, e.g., Antineoplastic effects of mammalian target of rapamycine inhibitors. Salvadori M. World J Transplant. 2012 Oct. 24; 2(5):74-83; Current and Future Treatment Strategies for Patients with Advanced Hepatocellular Carcinoma: Role of mTOR Inhibition. Finn R S. Liver Cancer. 2012 November; 1(3-4):247-256; Emerging Signaling Pathways in Hepatocellular Carcinoma. Moeini A, Cornelia H, Villanueva A. Liver Cancer. 2012 September; 1(2):83-93; Targeted cancer therapy—Are the days of systemic chemotherapy numbered? Joo W D, Visintin I, Mor G. Maturitas. 2013 Sep. 20; *Role of natural and adaptive immunity in renal cell carcinoma response to VEGFR-TKIs and mTOR inhibitor*. Santoni M, Berardi R, Amantini C, Burattini L, Santini D, Santoni G, Cascinu S. Int J Cancer. 2013 Oct. 2).

The present invention is based, at least in part, on the surprising finding that doses of mTOR inhibitors well below those used in current clinical settings had a superior effect in increasing an immune response in a subject and increasing the ratio of PD-1 negative T cells/PD-1 positive T cells. It was surprising that low doses of mTOR inhibitors, producing only partial inhibition of mTOR activity, were able to effectively improve immune responses in human subjects and increase the ratio of PD-1 negative T cells/PD-1 positive T cells.

Alternatively, or in addition, without wishing to be bound by any theory, it is believed that low, a low, immune enhancing, dose of an mTOR inhibitor can increase naive T cell numbers, e.g., at least transiently, e.g., as compared to a non-treated subject. Alternatively or additionally, again while not wishing to be bound by theory, it is believed that treatment with an mTOR inhibitor after a sufficient amount of time or sufficient dosing results in one or more of the following:

an increase in the expression of one or more of the following markers: $CD62L^{high}$, $CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased $CD62L^{high}$ increased $CD127^{high}$, increased $CD27^+$, decreased KLRG1, and increased BCL2;

and wherein any of the changes described above occurs, e.g., at least transiently, e.g., as compared to a non-treated subject (Araki, K et al. (2009) *Nature* 460:108-112). Memory T cell precursors are memory T cells that are early in the differentiation program. For example, memory T cells have one or more of the following characteristics: increased $CD62L^{high}$, increased $CD127^{high}$ increased $CD27^+$, decreased KLRG1, and/or increased BCL2.

In an embodiment, the invention relates to a composition, or dosage form, of an mTOR inhibitor, e.g., an allosteric mTOR inhibitor, e.g., a rapalog, rapamycin, or RAD001, or a catalytic mTOR inhibitor, which, when administered on a selected dosing regimen, e.g., once daily or once weekly, is associated with: a level of mTOR inhibition that is not associated with complete, or significant immune suppression, but is associated with enhancement of the immune response.

An mTOR inhibitor, e.g., an allosteric mTOR inhibitor, e.g., a rapalog, rapamycin, or RAD001, or a catalytic mTOR inhibitor, can be provided in a sustained release formulation. Any of the compositions or unit dosage forms described herein can be provided in a sustained release formulation. In some embodiments, a sustained release formulation will have lower bioavailability than an immediate release formulation. E.g., in embodiments, to attain a similar therapeutic effect of an immediate release formulation a sustained release formulation will have from about 2 to about 5, about 2.5 to about 3.5, or about 3 times the amount of inhibitor provided in the immediate release formulation.

In an embodiment, immediate release forms, e.g., of RAD001, typically used for one administration per week, having 0.1 to 20, 0.5 to 10, 2.5 to 7.5, 3 to 6, or about 5, mgs per unit dosage form, are provided. For once per week administrations, these immediate release formulations correspond to sustained release forms, having, respectively, 0.3 to 60, 1.5 to 30, 7.5 to 22.5, 9 to 18, or about 15 mgs of an mTOR inhibitor, e.g., an allosteric mTOR inhibitor, e.g., rapamycin or RAD001. In embodiments both forms are administered on a once/week basis.

In an embodiment, immediate release forms, e.g., of RAD001, typically used for one administration per day, having 0.005 to 1.5, 0.01 to 1.5, 0.1 to 1.5, 0.2 to 1.5, 0.3 to 1.5, 0.4 to 1.5, 0.5 to 1.5, 0.6 to 1.5, 0.7 to 1.5, 0.8 to 1.5, 1.0 to 1.5, 0.3 to 0.6, or about 0.5 mgs per unit dosage form, are provided. For once per day administrations, these immediate release forms correspond to sustained release forms, having, respectively, 0.015 to 4.5, 0.03 to 4.5, 0.3 to 4.5, 0.6 to 4.5, 0.9 to 4.5, 1.2 to 4.5, 1.5 to 4.5, 1.8 to 4.5, 2.1 to 4.5, 2.4 to 4.5, 3.0 to 4.5, 0.9 to 1.8, or about 1.5 mgs of an mTOR inhibitor, e.g., an allosteric mTOR inhibitor, e.g., rapamycin or RAD001. For once per week administrations, these immediate release forms correspond to sustained release forms, having, respectively, 0.1 to 30, 0.2 to 30, 2 to 30, 4 to 30, 6 to 30, 8 to 30, 10 to 30, 1.2 to 30, 14 to 30, 16 to 30, 20 to 30, 6 to 12, or about 10 mgs of an mTOR inhibitor, e.g., an allosteric mTOR inhibitor, e.g., rapamycin or RAD001.

In an embodiment, immediate release forms, e.g., of RAD001, typically used for one administration per day, having 0.01 to 1.0 mgs per unit dosage form, are provided. For once per day administrations, these immediate release forms correspond to sustained release forms, having, respectively, 0.03 to 3 mgs of an mTOR inhibitor, e.g., an allosteric mTOR inhibitor, e.g., rapamycin or RAD001. For once per week administrations, these immediate release forms correspond to sustained release forms, having, respectively, 0.2 to 20 mgs of an mTOR inhibitor, e.g., an allosteric mTOR inhibitor, e.g., rapamycin or RAD001.

In an embodiment, immediate release forms, e.g., of RAD001, typically used for one administration per week, having 0.5 to 5.0 mgs per unit dosage form, are provided. For once per week administrations, these immediate release forms correspond to sustained release forms, having, respectively, 1.5 to 15 mgs of an mTOR inhibitor, e.g., an allosteric mTOR inhibitor, e.g., rapamycin or RAD001.

As described above, one target of the mTOR pathway is the P70 S6 kinase. Thus, doses of mTOR inhibitors which are useful in the methods and compositions described herein are those which are sufficient to achieve no greater than 80% inhibition of P70 S6 kinase activity relative to the activity of the P70 S6 kinase in the absence of an mTOR inhibitor, e.g., as measured by an assay described herein, e.g., the Boulay assay. In a further aspect, the invention provides an amount of an mTOR inhibitor sufficient to achieve no greater than 38% inhibition of P70 S6 kinase activity relative to P70 S6 kinase activity in the absence of an mTOR inhibitor.

In one aspect the dose of mTOR inhibitor useful in the methods and compositions of the invention is sufficient to achieve, e.g., when administered to a human subject, 90+/−5% (i.e., 85-95%), 89+/−5%, 88+/−5%, 87+/−5%, 86+/−5%, 85+/−5%, 84+/−5%, 83+/−5%, 82+/−5%, 81+/−5%, 80+/−5%, 79+/−5%, 78+/−5%, 77+/−5%, 76+/−5%, 75+/−5%, 74+/−5%, 73+/−5%, 72+/−5%, 71+/−5%, 70+/−5%, 69+/−5%, 68+/−5%, 67+/−5%, 66+/−5%, 65+/−5%, 64+/−5%, 63+/−5%, 62+/−5%, 61+/−5%, 60+/−5%, 59+/−5%, 58+/−5%, 57+/−5%, 56+/−5%, 55+/−5%, 54+/−5%, 54+/−5%, 53+/−5%, 52+/−5%, 51+/−5%, 50+/−5%, 49+/−5%, 48+/−5%, 47+/−5%, 46+/−5%, 45+/−5%, 44+/−5%, 43+/−5%, 42+/−5%, 41+/−5%, 40+/−5%, 39+/−5%, 38+/−5%, 37+/−

5%, 36+/−5%, 35+/−5%, 34+/−5%, 33+/−5%, 32+/−5%, 31+/−5%, 30+/−5%, 29+/−5%, 28+/−5%, 27+/−5%, 26+/−5%, 25+/−5%, 24+/−5%, 23+/−5%, 22+/−5%, 21+/−5%, 20+/−5%, 19+/−5%, 18+/−5%, 17+/−5%, 16+/−5%, 15+/−5%, 14+/−5%, 13+/−5%, 12+/−5%, 11+/−5%, or 10+/−5%, inhibition of P70 S6 kinase activity, e.g., as measured by an assay described herein, e.g., the Boulay assay.

P70 S6 kinase activity in a subject may be measured using methods known in the art, such as, for example, according to the methods described in U.S. Pat. No. 7,727,950, by immunoblot analysis of phosphoP70 S6K levels and/or phosphoP70 S6 levels or by in vitro kinase activity assays.

As used herein, the term "about" in reference to a dose of mTOR inhibitor refers to up to a +/−10% variability in the amount of mTOR inhibitor, but can include no variability around the stated dose.

In some embodiments, the invention provides methods comprising administering to a subject an mTOR inhibitor, e.g., an allosteric inhibitor, e.g., RAD001, at a dosage within a target trough level. In some embodiments, the trough level is significantly lower than trough levels associated with dosing regimens used in organ transplant and cancer patients. In an embodiment mTOR inhibitor, e.g., RAD001, or rapamycin, is administered to result in a trough level that is less than ½, ¼, 1/10, or 1/20 of the trough level that results in immunosuppression or an anticancer effect. In an embodiment mTOR inhibitor, e.g., RAD001, or rapamycin, is administered to result in a trough level that is less than ½, ¼, 1/10, or 1/20 of the trough level provided on the FDA approved packaging insert for use in immunosuppression or an anticancer indications.

In an embodiment a method disclosed herein comprises administering to a subject an mTOR inhibitor, e.g., an allosteric inhibitor, e.g., RAD001, at a dosage that provides a target trough level of 0.1 to 10 ng/ml, 0.1 to 5 ng/ml, 0.1 to 3 ng/ml, 0.1 to 2 ng/ml, or 0.1 to 1 ng/ml.

In an embodiment a method disclosed herein comprises administering to a subject an mTOR inhibitor, e.g., an allosteric inhibitor, e.g., RAD001, at a dosage that provides a target trough level of 0.2 to 10 ng/ml, 0.2 to 5 ng/ml, 0.2 to 3 ng/ml, 0.2 to 2 ng/ml, or 0.2 to 1 ng/ml.

In an embodiment a method disclosed herein comprises administering to a subject an mTOR inhibitor, e.g. an, allosteric inhibitor, e.g., RAD001, at a dosage that provides a target trough level of 0.3 to 10 ng/ml, 0.3 to 5 ng/ml, 0.3 to 3 ng/ml, 0.3 to 2 ng/ml, or 0.3 to 1 ng/ml.

In an embodiment a method disclosed herein comprises administering to a subject an mTOR inhibitor, e.g., an allosteric inhibitor, e.g., RAD001, at a dosage that provides a target trough level of 0.4 to 10 ng/ml, 0.4 to 5 ng/ml, 0.4 to 3 ng/ml, 0.4 to 2 ng/ml, or 0.4 to 1 ng/ml.

In an embodiment a method disclosed herein comprises administering to a subject an mTOR inhibitor, e.g., an allosteric inhibitor, e.g., RAD001, at a dosage that provides a target trough level of 0.5 to 10 ng/ml, 0.5 to 5 ng/ml, 0.5 to 3 ng/ml, 0.5 to 2 ng/ml, or 0.5 to 1 ng/ml.

In an embodiment a method disclosed herein comprises administering to a subject an mTOR inhibitor, e.g., an allosteric inhibitor, e.g., RAD001, at a dosage that provides a target trough level of 1 to 10 ng/ml, 1 to 5 ng/ml, 1 to 3 ng/ml, or 1 to 2 ng/ml.

As used herein, the term "trough level" refers to the concentration of a drug in plasma just before the next dose, or the minimum drug concentration between two doses.

In some embodiments, a target trough level of RAD001 is in a range of between about 0.1 and 4.9 ng/ml. In an embodiment, the target trough level is below 3 ng/ml, e.g., is between 0.3 or less and 3 ng/ml. In an embodiment, the target trough level is below 3 ng/ml, e.g., is between 0.3 or less and 1 ng/ml.

In a further aspect, the invention can utilize an mTOR inhibitor other than RAD001 in an amount that is associated with a target trough level that is bioequivalent to the specified target trough level for RAD001. In an embodiment, the target trough level for an mTOR inhibitor other than RAD001, is a level that gives the same level of mTOR inhibition (e.g., as measured by a method described herein, e.g., the inhibition of P70 S6) as does a trough level of RAD001 described herein.

Pharmaceutical Compositions: mTOR Inhibitors

In one aspect, the present invention relates to pharmaceutical compositions comprising an mTOR inhibitor, e.g., an mTOR inhibitor as described herein, formulated for use in combination with CAR cells described herein.

In some embodiments, the mTOR inhibitor is formulated for administration in combination with an additional, e.g., as described herein.

In general, compounds of the invention will be administered in therapeutically effective amounts as described above via any of the usual and acceptable modes known in the art, either singly or in combination with one or more therapeutic agents.

The pharmaceutical formulations may be prepared using conventional dissolution and mixing procedures. For example, the bulk drug substance (e.g., an mTOR inhibitor or stabilized form of the compound (e.g., complex with a cyclodextrin derivative or other known complexation agent) is dissolved in a suitable solvent in the presence of one or more of the excipients described herein. The mTOR inhibitor is typically formulated into pharmaceutical dosage forms to provide an easily controllable dosage of the drug and to give the patient an elegant and easily handleable product.

Compounds of the invention can be administered as pharmaceutical compositions by any conventional route, in particular enterally, e.g., orally, e.g., in the form of tablets or capsules, or parenterally, e.g., in the form of injectable solutions or suspensions, topically, e.g., in the form of lotions, gels, ointments or creams, or in a nasal or suppository form. Where an mTOR inhibitor is administered in combination with (either simultaneously with or separately from) another agent as described herein, in one aspect, both components can be administered by the same route (e.g., parenterally). Alternatively, another agent may be administered by a different route relative to the mTOR inhibitor. For example, an mTOR inhibitor may be administered orally and the other agent may be administered parenterally.

Sustained Release mTOR inhibitors, e.g., allosteric mTOR inhibitors or catalytic mTOR inhibitors, disclosed herein can be provided as pharmaceutical formulations in form of oral solid dosage forms comprising an mTOR inhibitor disclosed herein, e.g., rapamycin or RAD001, which satisfy product stability requirements and/or have favorable pharmacokinetic properties over the immediate release (IR) tablets, such as reduced average plasma peak concentrations, reduced inter- and intra-patient variability in the extent of drug absorption and in the plasma peak concentration, reduced $C_{max}/C_{min}$ ratio and/or reduced food effects. Provided pharmaceutical formulations may allow for more precise dose adjustment and/or reduce frequency of adverse events thus providing safer treatments for patients with an mTOR inhibitor disclosed herein, e.g., rapamycin or RAD001.

In some embodiments, the present disclosure provides stable extended release formulations of an mTOR inhibitor disclosed herein, e.g., rapamycin or RAD001, which are multi-particulate systems and may have functional layers and coatings.

The term "extended release" multi-particulate formulation as used herein refers to a formulation which enables release of an mTOR inhibitor disclosed herein, e.g., rapamycin or RAD001, over an extended period of time e.g. over at least 1, 2, 3, 4, 5 or 6 hours. The extended release formulation may contain matrices and coatings made of special excipients, e.g., as described herein, which are formulated in a manner as to make the active ingredient available over an extended period of time following ingestion.

The term "extended release" can be interchangeably used with the terms "sustained release" (SR) or "prolonged release". The term "extended release" relates to a pharmaceutical formulation that does not release active drug substance immediately after oral dosing but over an extended in accordance with the definition in the pharmacopoeias Ph. Eur. ($7^{th}$ edition) mongraph for tablets and capsules and USP general chapter <1151> for pharmaceutical dosage forms. The term "Immediate Release" (IR) as used herein refers to a pharmaceutical formulation which releases 85% of the active drug substance within less than 60 minutes in accordance with the definition of "Guidance for Industry: "Dissolution Testing of Immediate Release Solid Oral Dosage Forms" (FDA CDER, 1997). In some embodiments, the term "immediate release" means release of everolismus from tablets within the time of 30 minutes, e.g., as measured in the dissolution assay described herein.

Stable extended release formulations of an mTOR inhibitor disclosed herein, e.g., rapamycin or RAD001, can be characterized by an in-vitro release profile using assays known in the art, such as a dissolution assay as described herein: a dissolution vessel filled with 900 mL phosphate buffer pH 6.8 containing sodium dodecyl sulfate 0.2% at 37° C. and the dissolution is performed using a paddle method at 75 rpm according to USP by according to USP testing monograph 711, and Ph. Eur. testing monograph 2.9.3. respectively.

In some embodiments, stable extended release formulations of an mTOR inhibitor disclosed herein, e.g., rapamycin or RAD001, release the mTOR inhibitor in the in-vitro release assay according to following release specifications:

0.5 h: <45%, or <40, e.g., <30%
1 h: 20-80%, e.g., 30-60%
2 h: >50%, or >70%, e.g., >75%
3 h: >60%, or >65%, e.g., >85%, e.g., >90%.

In some embodiments, stable extended release formulations of an mTOR inhibitor disclosed herein, e.g., rapamycin or RAD001, release 50% of the mTOR inhibitor not earlier than 45, 60, 75, 90, 105 min or 120 min in the in-vitro dissolution assay.

Biopolymer Delivery Methods

In some embodiments, one or more CAR-expressing cells as disclosed herein can be administered or delivered to the subject via a biopolymer scaffold, e.g., a biopolymer implant. Biopolymer scaffolds can support or enhance the delivery, expansion, and/or dispersion of the CAR-expressing cells described herein. A biopolymer scaffold comprises a biocompatible (e.g., does not substantially induce an inflammatory or immune response) and/or a biodegradable polymer that can be naturally occurring or synthetic.

Examples of suitable biopolymers include, but are not limited to, agar, agarose, alginate, alginate/calcium phosphate cement (CPC), beta-galactosidase (β-GAL), (1,2,3,4, 6-pentaacetyl a-D-galactose), cellulose, chitin, chitosan, collagen, elastin, gelatin, hyaluronic acid collagen, hydroxyapatite, poly(3-hydroxybutyrate-co-3-hydroxyhexanoate) (PHBHHx), poly(lactide), poly(caprolactone) (PCL), poly(lactide-co-glycolide) (PLG), polyethylene oxide (PEO), poly(lactic-co-glycolic acid) (PLGA), polypropylene oxide (PPO), polyvinyl alcohol) (PVA), silk, soy protein, and soy protein isolate, alone or in combination with any other polymer composition, in any concentration and in any ratio. The biopolymer can be augmented or modified with adhesion- or migration-promoting molecules, e.g., collagen-mimetic peptides that bind to the collagen receptor of lymphocytes, and/or stimulatory molecules to enhance the delivery, expansion, or function, e.g., anti-cancer activity, of the cells to be delivered. The biopolymer scaffold can be an injectable, e.g., a gel or a semi-solid, or a solid composition.

In some embodiments, CAR-expressing cells described herein are seeded onto the biopolymer scaffold prior to delivery to the subject. In embodiments, the biopolymer scaffold further comprises one or more additional therapeutic agents described herein (e.g., another CAR-expressing cell, an antibody, or a small molecule) or agents that enhance the activity of a CAR-expressing cell, e.g., incorporated or conjugated to the biopolymers of the scaffold. In embodiments, the biopolymer scaffold is injected, e.g., intratumorally, or surgically implanted at the tumor or within a proximity of the tumor sufficient to mediate an anti-tumor effect. Additional examples of biopolymer compositions and methods for their delivery are described in Stephan et al., *Nature Biotechnology*, 2015, 33:97-101; and WO2014/110591.

Pharmaceutical Compositions and Treatments

Pharmaceutical compositions of the present invention may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, mycoplasma, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom according to the present invention, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions of the present invention are administered to a patient by intradermal or subcutaneous injection. In one aspect, the T cell compositions of the present invention are administered by i.v. injection. The compositions of immune effector cells (e.g., T cells, NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated such that one or more CAR constructs of the invention may be introduced, thereby creating a CAR T cell of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR T cells of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described in U.S. Pat. No. 6,120,766).

In one embodiment, the CAR is introduced into immune effector cells (e.g., T cells, NK cells), e.g., using in vitro transcription, and the subject (e.g., human) receives an initial administration of CAR immune effector cells (e.g., T cells, NK cells) of the invention, and one or more subsequent administrations of the CAR immune effector cells (e.g., T cells, NK cells) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR immune effector cells (e.g., T cells, NK cells) of the invention are administered to the subject (e.g., human) per week, e.g., 2, 3, or 4 administrations of the CAR immune effector cells (e.g., T cells, NK cells) of the invention are administered per week. In one embodiment, the subject (e.g., human subject) receives more than one administration of the CAR immune effector cells (e.g., T cells, NK cells) per week (e.g., 2, 3 or 4 administrations per week) (also referred to herein as a cycle), followed by a week of no CAR immune effector cells (e.g., T cells, NK cells) administrations, and then one or more additional administration of the CAR immune effector cells (e.g., T cells, NK cells) (e.g., more than one administration of the CAR immune effector cells (e.g., T cells, NK cells) per week) is administered to the subject. In another embodiment, the subject (e.g., human subject) receives more than one cycle of CAR immune effector cells (e.g., T cells, NK cells), and the time between each cycle is less than 10, 9, 8, 7, 6, 5, 4, or 3 days. In one embodiment, the CAR immune effector cells (e.g., T cells, NK cells) are administered every other day for 3 administrations per week. In one embodiment, the CAR immune effector cells (e.g., T cells, NK cells) of the invention are administered for at least two, three, four, five, six, seven, eight or more weeks.

In one aspect, CAR-expressing cells of the present inventions are generated using lentiviral viral vectors, such as lentivirus. Cells, e.g., CARTs, generated that way will have stable CAR expression.

In one aspect, CAR-expressing cells, e.g., CARTs, are generated using a viral vector such as a gammaretroviral vector, e.g., a gammaretroviral vector described herein. CARTs generated using these vectors can have stable CAR expression.

In one aspect, CARTs transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the T cell by electroporation.

A potential issue that can arise in patients being treated using transiently expressing CAR immune effector cells (e.g., T cells, NK cells) (particularly with murine scFv bearing CARTs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CART infusion breaks should not last more than ten to fourteen days.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Example 1

Methods

Isolation, Transduction, and Expansion of Primary Human T Lymphocytes

Blood samples were obtained from the Human Immunology Core of the University of Pennsylvania. Peripheral blood $CD4^+$ and $CD8^+$ T cells were negatively isolated using RosetteSep Kits (Stem cell Technologies). Cells were cultured in RPMI 1640 media supplemented with 10% FCS, 100-U/ml penicillin, 100 μg/ml streptomycin sulfate, 10 mM HEPES in a 37° C. and 5% $CO^2$ incubator. For stimulation, $CD4^+$ and $CD8^+$ T cells were cultured with activating beads coated with antibodies to CD3 and CD28 at a 1:3 cell to bead ratio. Approximately 24 h after activation, T cells were transduced with lentiviral vectors at an MOI of 3-5. For $CD8^+$ T cells, human IL-2 (Chiron) was added every other day to a final concentration of 30 IU/ml. Cells were counted and fed every 2 days and once T cells appeared to rest down, as determined by both decreased growth kinetics and cell size, they were either used for functional assays or cryopreserved. All T cell functional assays were performed in media without cytokines.

Mutation of CAR Signaling Domain

Plasmids containing chimeric antigen sequence for meosthelin-specific SS1-28z CAR T cells were modified through site-directed mutagenesis to change the YMNM (SEQ ID NO: 1947) amino acid motif to YMFM (SEQ ID NO: 1937), FMNM (SEQ ID NO: 1948), and FMFM (SEQ ID NO: 1949) using complementary overlapping primers.

Luminex Cytokine Measurement

Mesothelin-specific SS1 CART cells (50% chimeric-receptor positive; 1:1 CD4:CD8 ratio) were co-cultured with mesothelin-Fc coated magnetic beads overnight in a 37° C. and 5% $CO^2$ incubator. Culture supernatant was removed the next day and analyzed using the Cytokine Human 10-Plex Panel for the Luminex platform (Thermo Fisher).

Mice

The University of Pennsylvania Institutional Animal Care and Use Committee approved all animal experiments. NSG mice were purchased from The Jackson Laboratory and bred in the vivarium at the University of Pennsylvania. The mice were housed under specific pathogen-free conditions in microisolator cages and given ad libitum access to autoclaved food and acidified water.

In Vivo Assessment of Anti-Mesothelin CAR T Cells

Xenograft tumors were established by intraperitoneal injection of $1 \times 10^6$ luciferase$^+$ ASPC-1 cells in PBS or subcutaneous injection of $5 \times 10^6$ Capan-1 cells in the presence of a 50% solution of Matrigel (BD Biosciences) in PBS. ASPC-1 tumors were allowed to grow in NSG mice until mean tumor bioluminescence was $10^8$ p/s. Capan-1 tumors were allowed to grow in NSG mice for 3 weeks. Mice were then treated with one intravenous injection of $1 \times 10^7$ CART cells (ASPC-1 model) or two intravenous injections of $1 \times 10^7$ CART cells (CAPAN-1 model) at day 0 and day 15. All CAR T cell groups were 50% chimeric receptor-positive with a 1:1 $CD4^+$:$CD8^+$ ratio. Tumor bioluminescence (ASPC-1 model) was measured through serial weekly imaging on a Xenogen IVIS-200 Spectrum camera after 100 μL intraperitoneal injection of luciferin (30 mg/mL). Tumor dimensions were measured with calipers (CAPAN-1 model), and tumor volumes calculated using the formula $V=1/2 \times L \times W \times W$, where L is length (longest dimension) and W is width (shortest dimension). Peripheral blood was obtained from retro-orbital bleeding on day 30 and 60 after T cell injection (CAPAN-1 model) and stained for the presence of human CD45, CD4, and CD8 T cells. After gating on the human $CD45^+$ population, the $CD4^+$ and $CD8^+$ subsets were quantified using TruCount tubes (BD Biosciences). All experiments were performed in a blinded, randomized fashion.

Example 2

Mesothelin-targeting CAR T cells, engineered to express the SS 1 scFv on the cellular surface and the CD28 costimulatory domain intracellular, as well as the CD3ζ chain, were mutated in the YMNM (SEQ ID NO: 1947) motif to YMFM (SEQ ID NO: 1937) in order to ablate interaction with PI3K, and FMFM (SEQ ID NO: 1949), which removes interactions between PI3K and Grb2 (FIG. 1B).

Example 3

Human T cells expressing the CARs of FIG. 1A were generated through lentiviral transduction with CAR-encoding plasmids and evaluated for the ability of mutated CAR T cells to treat an intraperitoneal human pancreatic tumor growth in immunodeficient NSG mice. Through serial bioluminescent imaging, a reduction of tumor bioluminescence was observed in all groups treated with CD28-costimulated CAR T cells, while mice treated with non-transduced (NTD) T cells or 4-1BB-costimulated CAR T cells failed to reduce the tumor growth (FIG. 2A). However, at 26 days post T cell infusion, a plateau on tumor bioluminescence was observed in the group treated with conventional CD28-costimulated CAR T cells, while mutated CD28-costimulated CAR T cell groups continued to reduce tumor burden until the end of the experiment, 40 days post T cell infusion.

Figure 2B:
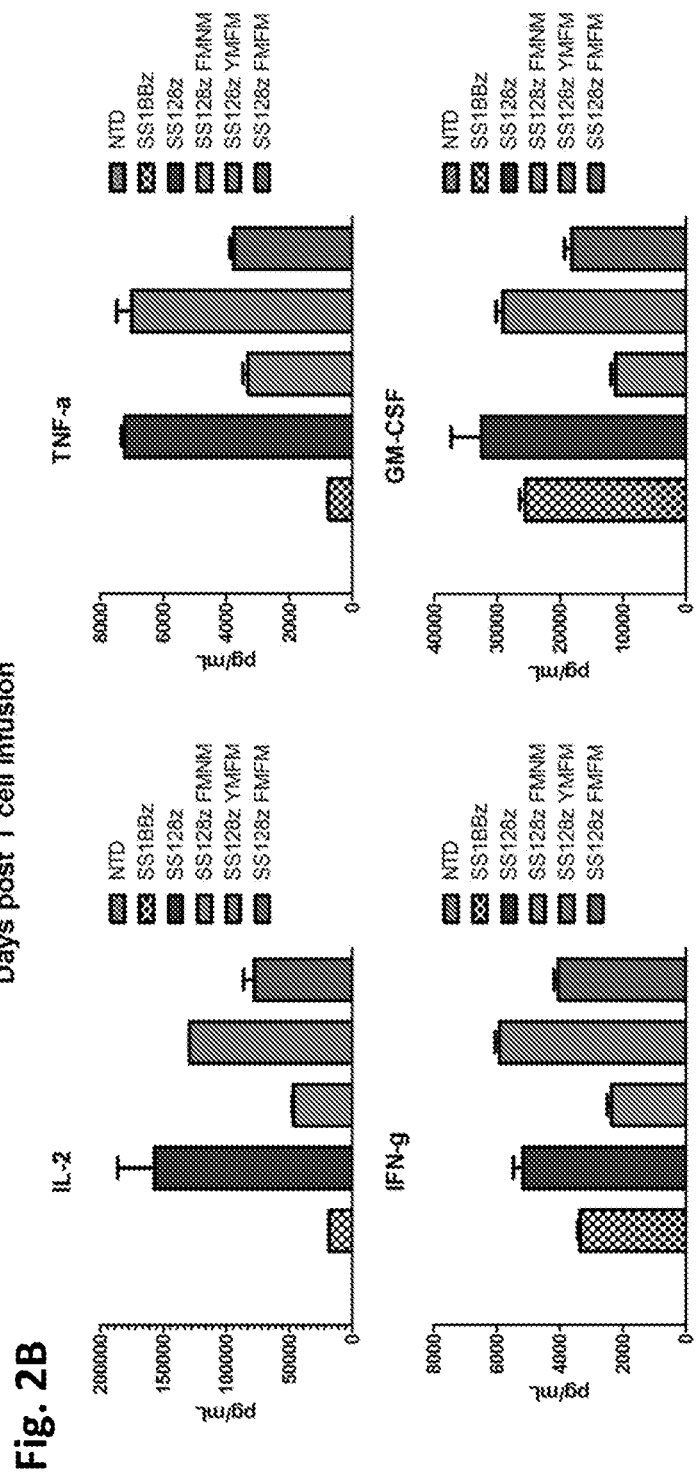
FIG. 2B is a set of graphs of cytokine release of the indicated T cells when stimulated with mesothelin-Fc coated magnetic beads for 24 hours. NTD is a negative control and SS128z is a positive control.

In vitro, CD28-costimulated CAR T cells, as well as NTD and 4-1BB-costimulated CAR T cells, were cultured with mesothelia-Fc-coated magnetic beads for 24 hours. Cytokines secreted in the cell culture media were measured through a 10-plex luminex assay and significant changes in IL-2, IFN-γ, TNF-α, and GM-CSF were observed (FIG. 2B). Specifically, mutants with abrogation of PI3K through FMNM (SEQ ID NO: 1948) and FMFM (SEQ ID NO: 1949) motifs displayed a significant reduction of secreted $T_h1$ cytokines. Contrary, the CD28-mutant with the same motif as ICOS, YMFM (SEQ ID NO: 1937), did not display an altered cytokine profile.

Example 4

The therapeutic potential of CD28 mutants was investigated compared with CD28ζ and ICOSζ CARs. After establishing subcutaneous pancreatic tumors in NSG mice for 21 days, mice were treated with two doses of redirected T cells (10 million, 50% CAR$^+$) on days 0 and 15. Non-treated animals and animals treated with untransduced (UTD) T cells showed tumor progression and had to be sacrificed by day 40 after treatment. Treatment with 28z showed an initial decrease in tumor burden, but T cells did not persist in the treated animals and by day 30 tumors started to progress (FIGS. 3A, 3B, and 3C). Animals treated with ICOSλ showed a slower antitumor effect when compared to 28z treated animals. By contrast to 28ζ treatment, ICOSζ T cells showed great blood persistence, and after 35 days of stable disease tumors started to regress. Interestingly, all CD28 mutants showed enhanced antitumor effect when compared to 28ζ CART cells. Replacement of the CD28 motif YMNM (SEQ ID NO: 1947) for the ICOSζ YMFM (SEQ ID NO: 1937) motif enhanced T cell persistence at similar levels of those observed in animals treated with ICOSζ CART cells. All animals treated with the CD28-YMFM (SEQ ID NO: 1937) mutant were tumor free by the end of the experiment.

Example 5

Human normal donor anti-mesothelin CAR-T cells were loaded with ratiometric calcium-sensitive dye Indo-1AM (1 µM) for 30 minutes at 37° C. Cells were then washed, resuspended in $Ca^{2+}$-containing HBSS buffer, and analyzed by a flow cytometer equipped with a UV laser and filters at 395 nm and 510 nm for violet and blue emissions. Acquisition was performed for 30 seconds to measure basal calcium flux. Cells were quickly removed from the cytometer and 24 µg of recombinant mesothelin-Fc was added directly to the cell suspension; the cells were vortexed and immediately returned to the cytometer for 6 minutes of acquisition. Cells were quickly removed from the cytometer and 1 µg/mL of ionomycin was added to the cell suspension; the cells were vortexed and immediately returned to the cytometer for another 6 minutes of acquisition.

Figure 4A:
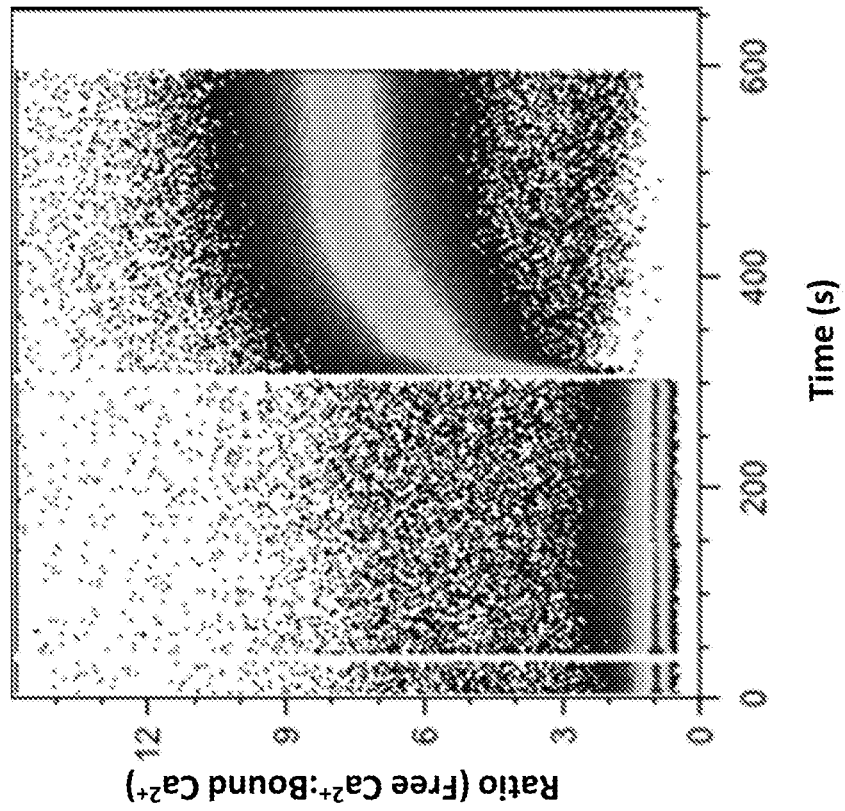
FIGS. 4A and 4B are a pair of flow cytometric plots showing calcium flux in T cells expressing anti-mesothelin CAR with a wild type CD28 costimulatory domain (FIG. 4A) or T cells expressing anti-mesothelin CAR with a CD28 costimulatory domain with the YMFM mutation (FIG. 4B).
Figure 4B:
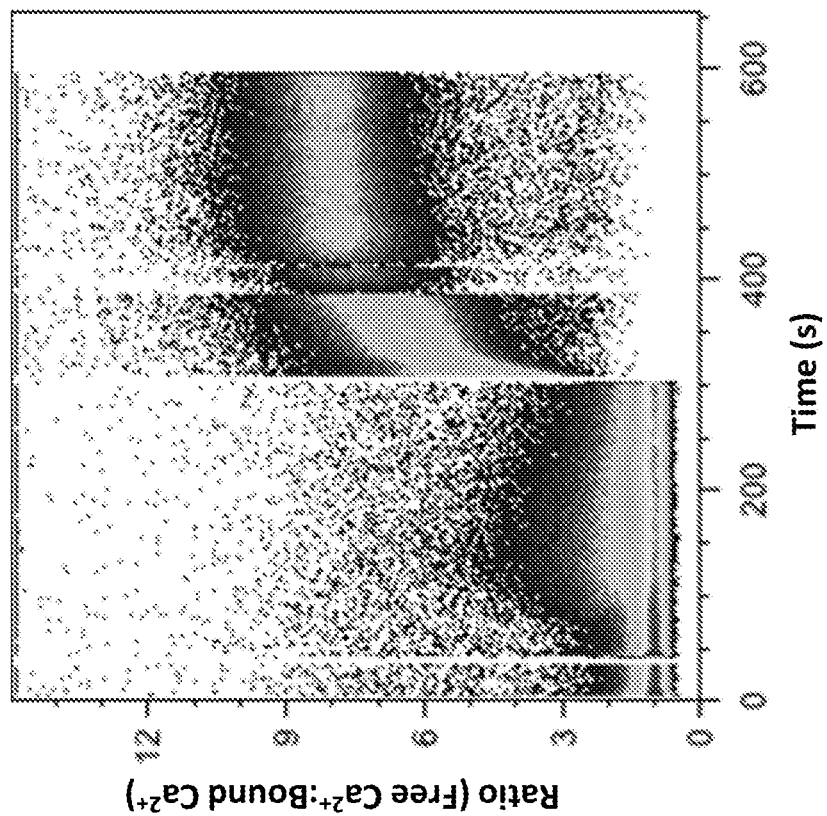

Calcium flux in cells expressing anti-mesothelin CAR with the YMFM (SEQ ID NO: 1937) mutation (FIG. 4B) was reduced compared to that in cells expressing the corresponding wild type CAR (FIG. 4A).

Example 6

Human normal donor anti-mesothelin CAR-T cells were stimulated on mesothelin-Fc coated plates for 4 days. Cell-ROX Green Reagent (Life Technologies) was added to the cells at a final concentration of 5 µM and incubated for 30 minutes at 37° C. Cells were washed three times in PBS and analyzed for CellROX Green fluorescence by flow cytometry. Measurement is shown as normalization to CellROX Green fluorescence of non-stimulated anti-mesothelin CAR-T cells.

Figure 5A:
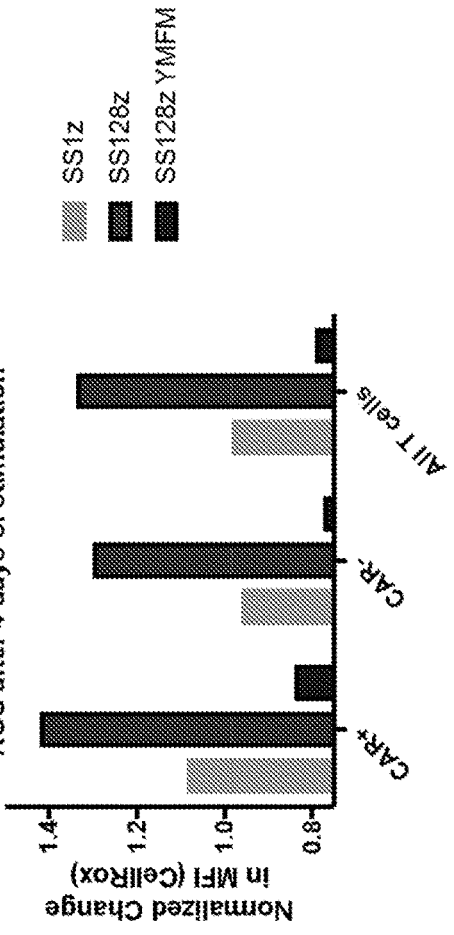
FIG. 5A is a graph showing relative ROS levels for indicated cell populations. The y axis shows normalized change in MFI relative to non-stimulated anti-mesothelin CAR-T cells.

As shown in FIG. 5A, the presence of the wild type CD28 costimulatory domain in anti-mesothelin CAR increased ROS levels. Replacing the CD28 motif YMNM for the ICOSζ YMFM (SEQ ID NO: 1937) motif significantly reduced the ROS levels.

RNA was collected from non-stimulated human normal donor anti-mesothelin CAR-T cells or cells stimulated on mesothelin-Fc coated plates for 4 or 8 days. cDNA was synthesized according to the SuperScript III First-Strand Synthesis Kit (Life Technologies) protocol. Expression of Tox2 was measured on a Viia 7 Real-Time PCR System (Applied Biosystems) using a Tox2-specific Taqman probe set (Thermo Fisher; Hs00262775_m1).

Figure 5B:
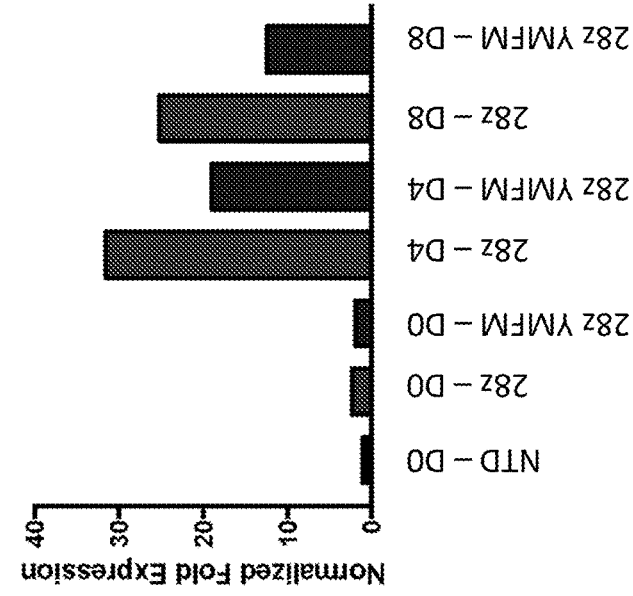
FIG. 5B is a graph showing normalized fold expression of Tox2 for indicated conditions.

As shown in FIG. 5B, the CD28-mutant YMFM (SEQ ID NO: 1937) also reduced the RNA level of the exhaustion marker Tox2 on T cells.

Example 7

Human normal donor anti-mesothelin CAR-T cells were stimulated with mesothelin-Fc coated Dynabeads at a 3:1 beads to T cell ratio at 37° C. for 5 or 10 minutes. Protein lysates were collected and quantified by Bradford Assay and electrophoresed on a polyacrylamide gel. Protein lysates were immunoblotted with antibodies for pAKT, AKT, pPLCγ, PLCγ, pERK, ERK (Cell Signaling Technologies), pVav (Abcam), and Vav (Santa Cruz Biotechnology) and exposed through chemiluminescence.

Figure 6A:
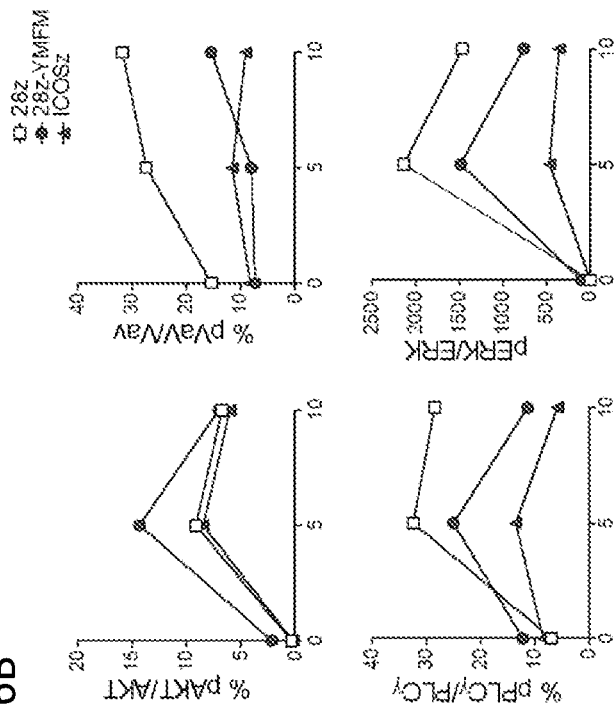
FIG. 6A is a panel of western blots showing staining of pAKT, AKT, pVav, Vav, pPLCγ, PLCγ, pERK, and ERK for the indicated cell lines.
Figure 6B:
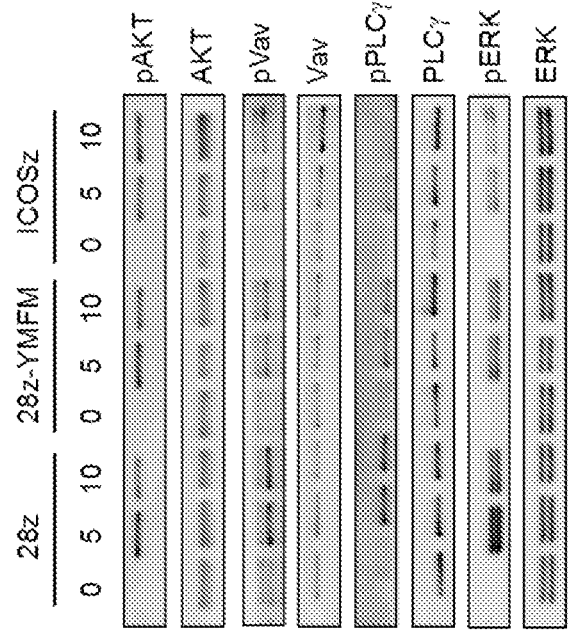
FIGS. 6B and 6C are a panel of graphs showing quantification of the western blot data shown in FIG. 6A.
Figure 6C:
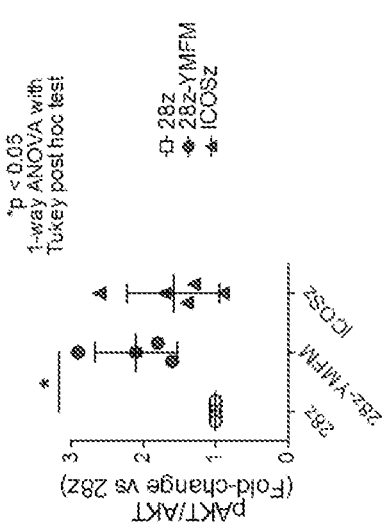

Introducing the YMFM (SEQ ID NO: 1937) mutation in the CD28 costimulatory domain led to altered signaling in T cells, reducing phosphorylation of Vav, PLCγ, and ERK (FIG. 6B) and increasing the phosphorylation of AKT (FIGS. 6B and 6C).

EQUIVALENTS

The disclosures of each and every patent, patent application, and publication cited herein are hereby incorporated herein by reference in their entirety. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (1950 sequences)

SEQ ID NO: 1 - protein, 41 aa, Artificial Sequence
  source: /note="Description of Artificial Sequence: Synthetic polypeptide"
  MOD_RES (12)..(12): Any amino acid
  MOD_RES (14)..(14): Any amino acid
  source: /note="See specification as filed for detailed description of substitutions and preferred embodiments"
RSKRSRLLHSDXMXMTPRRPGPTRKHYQPYAPPRDFAAYRS

SEQ ID NO: 2 - protein, 41 aa, Artificial Sequence
  source: /note="Description of Artificial Sequence: Synthetic polypeptide"
RSKRSRLLHSDYMFMTPRRPGPTRKHYQPYAPPRDFAAYRS

SEQ ID NO: 3 - protein, 41 aa, Artificial Sequence
  source: /note="Description of Artificial Sequence: Synthetic polypeptide"
RSKRSRLLHSDFMNMTPRRPGPTRKHYQPYAPPRDFAAYRS

SEQ ID NO: 4 - protein, 41 aa, Artificial Sequence
  source: /note="Description of Artificial Sequence: Synthetic polypeptide"
RSKRSRLLHSDFMFMTPRRPGPTRKHYQPYAPPRDFAAYRS

SEQ ID NO: 5 - protein, 41 aa, Artificial Sequence
  source: /note="Description of Artificial Sequence: Synthetic polypeptide"
RSKRSRLLHSDYMNMTPRRPGPTRKHYQPYAPPRDFAAYRS

SEQ ID NO: 6 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 7 - DNA, 123 bp, Artificial Sequence
  source: /note="Description of Artificial Sequence: Synthetic polynucleotide"
aggagtaagaggagcaggctcctgcacagtgactacatgttcatgactccccgccgccccgggcccacccgcaagcattaccagccctatgccccaccacgcgacttcgcagcctatcgctcc

SEQ ID NO: 8 - DNA, 123 bp, Artificial Sequence
  source: /note="Description of Artificial Sequence: Synthetic polynucleotide"
aggagtaagaggagcaggctcctgcacagtgacttcatgaacatgactccccgccgccccgggcccacccgcaagcattaccagccctatgccccaccacgcgacttcgcagcctatcgctcc

SEQ ID NO: 9 - DNA, 123 bp, Artificial Sequence
  source: /note="Description of Artificial Sequence: Synthetic polynucleotide"
aggagtaagaggagcaggctcctgcacagtgacttcatgttcatgactccccgccgccccgggcccacccgcaagcattaccagccctatgccccaccacgcgacttcgcagcctatcgctcc

SEQ ID NO: 10 - protein, 10 aa, Artificial Sequence
  source: /note="Description of Artificial Sequence: Synthetic peptide"
GGGGSGGGGS

SEQ ID NO: 11 - DNA, 30 bp, Artificial Sequence
  source: /note="Description of Artificial Sequence: Synthetic oligonucleotide"
ggtggcggaggttctggaggtggaggttcc

SEQ ID NO: 12 - protein, 24 aa, Artificial Sequence
  source: /note="Description of Artificial Sequence: Synthetic peptide"
IYIWAPLAGTCGVLLLSLVITLYC

SEQ ID NO: 13 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 14 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 15 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 16 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 17 - DNA, 123 bp, Artificial Sequence; identical to SEQ ID NO: 6
  source: /note="Description of Artificial Sequence: Synthetic polynucleotide"

SEQ ID NO: 18 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 19 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 20 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 21 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 5 aa, Artificial Sequence
  source: /note="Description of Artificial Sequence: Synthetic peptide"
GGGGS

SEQ ID NO: 23 - DNA, 30 bp, Artificial Sequence; identical to SEQ ID NO: 11
  source: /note="Description of Artificial Sequence: Synthetic oligonucleotide"

SEQ ID NO: 24 - protein, 150 aa, Artificial Sequence [sequence omitted]

SEQ ID NO: 25 - DNA, 450 bp, Artificial Sequence
  source: /note="Description of Artificial Sequence: Synthetic polynucleotide"
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtc

SEQ ID NO: 26 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 27 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 28 - protein, 40 aa, Artificial Sequence
  source: /note="Description of Artificial Sequence: Synthetic polypeptide"
  MISC_FEATURE (1)..(40): /note="This sequence may encompass 1-10 'Gly Gly Gly Ser' repeating units"
  source: /note="See specification as filed for detailed description of substitutions and preferred embodiments"
GGGSGGGSGGGSGGGSGGGSGGGSGGGSGGGSGGGSGGGS

SEQ ID NO: 29 - protein, 20 aa, Artificial Sequence
  source: /note="Description of Artificial Sequence: Synthetic peptide"
GGGGSGGGGSGGGGSGGGGS

SEQ ID NO: 30 - protein, 15 aa, Artificial Sequence
  source: /note="Description of Artificial Sequence: Synthetic peptide"
GGGGSGGGGSGGGGS

SEQ ID NO: 31 - protein, 4 aa, Artificial Sequence
  source: /note="Description of Artificial Sequence: Synthetic peptide"
GGGS

SEQ ID NO: 32 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 33 - DNA, 150 bp, Artificial Sequence
  source: /note="Description of Artificial Sequence: Synthetic polynucleotide"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 34 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 36 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 37 - DNA, 5000 bp, Artificial Sequence; identical to SEQ ID NO: 34
  source: /note="Description of Artificial Sequence: Synthetic polynucleotide"
  misc_feature (1)..(5000): /note="This sequence may encompass 100-5000 nucleotides"
  source: /note="See specification as filed for detailed description of substitutions and preferred embodiments"

SEQ ID NO: 38 - DNA, 400 bp, Artificial Sequence
  source: /note="Description of Artificial Sequence: Synthetic polynucleotide"
  misc_feature (1)..(400): /note="This sequence may encompass 100-400 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 39 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 40-51 - skipped (12 entries)

SEQ ID NO: 52 - protein, 132 aa, Artificial Sequence
  source: /note="Description of Artificial Sequence: Synthetic polypeptide"
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 53 - protein, 108 aa, Artificial Sequence
  source: /note="Description of Artificial Sequence: Synthetic polypeptide"
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 54 - protein, 93 aa, Artificial Sequence [sequence omitted]

SEQ ID NO: 55 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 56 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 57 - protein, 95 aa, Artificial Sequence
  source: /note="Description of Artificial Sequence: Synthetic polypeptide"
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 58 - protein, 95 aa, Artificial Sequence
  source: /note="Description of Artificial Sequence: Synthetic polypeptide"
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 59 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 60 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 61 - protein, 1132 aa, Homo sapiens [sequence omitted]

SEQ ID NO: 62 - DNA, 4027 bp, Homo sapiens
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 63-77 - skipped (15 entries)

SEQ ID NO: 78 - protein, 30 aa, Artificial Sequence
  source: /note="Description of Artificial Sequence: Synthetic polypeptide"
  MISC_FEATURE (1)..(30): /note="This sequence may encompass 1-6 'Gly Gly Gly Gly Ser' repeating units"
  source: /note="See specification as filed for detailed description of substitutions and preferred embodiments"
GGGGSGGGGSGGGGSGGGGSGGGGSGGGGS

SEQ ID NO: 79-111 - skipped (33 entries)

SEQ ID NO: 112 - protein, 4 aa, Artificial Sequence
  source: /note="Description of Artificial Sequence: Synthetic peptide"
RGDS

SEQ ID NO: 113-399 - skipped (287 entries)

SEQ ID NO: 400 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 401 - protein, 21 aa, Artificial Sequence
  source: /note="Description of Artificial Sequence: Synthetic peptide"
MALPVTALLLPLALLLHAARP

SEQ ID NO: 402 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 403 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 404 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 405 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 406 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 407 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 408 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 409 - protein, 107 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 410 - protein, 120 aa, Artificial Sequence
  source: /note="Description of Artificial Sequence: Synthetic polypeptide"
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 411 - protein, 245 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 412 - protein, 489 aa, Artificial Sequence
  source: /note="Description of Artificial Sequence: Synthetic polypeptide"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMFMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 413 - protein, 489 aa, Artificial Sequence
  source: /note="Description of Artificial Sequence: Synthetic polypeptide"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDFMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 414 - protein, 489 aa, Artificial Sequence
  source: /note="Description of Artificial Sequence: Synthetic polypeptide"
MLLLVTSLLLCELPHPAFLLIPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDFMFMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 415 - protein, 109 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 416 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 417 - protein, 244 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 418 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMFMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 419 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDFMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 420 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDFMFMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 421 - protein, 107 aa, Artificial Sequence; identical to SEQ ID NO: 409
  source: /note="Description of Artificial Sequence: Synthetic polypeptide"

SEQ ID NO: 422 - protein, 121 aa, Artificial Sequence
  source: /note="Description of Artificial Sequence: Synthetic polypeptide"
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 423 - protein, 246 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 424 - protein, 111 aa, Artificial Sequence
  source: /note="Description of Artificial Sequence: Synthetic polypeptide"
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 425 - protein, 117 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 426 - protein, 246 aa, Artificial Sequence
  source: /note="Description of Artificial Sequence: Synthetic polypeptide"
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGSTSGSGKPGSGEGSTKGQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 427-890 - skipped (464 entries)

SEQ ID NO: 891 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 892 - protein, 465 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 893 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 894 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 895 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 896 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 897 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 898 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 899 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 900 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 901 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 902 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 903 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 904 - DNA, 813 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 905 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 906 - DNA, 1458 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 907 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 908 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 909 - DNA, 813 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 910 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 911 - DNA, 1458 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 912 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 913 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 914 - DNA, 828 bp, Artificial Sequence
  source: /note="Description of Artificial Sequence: Synthetic polynucleotide"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactactcttcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 915 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 916 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggcggaggcgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactactcttcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 917 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 918 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 919 - DNA, 828 bp, Artificial Sequence
  source: /note="Description of Artificial Sequence: Synthetic polynucleotide"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactaccagtcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 920 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 921 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggagggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 922 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 923 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 924 - DNA, 828 bp, Artificial Sequence
  source: /note="Description of Artificial Sequence: Synthetic polynucleotide"
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactactcatcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 925 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 926 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactattcatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 927 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 928 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 929 - DNA, 828 bp, Artificial Sequence
  source: /note="Description of Artificial Sequence: Synthetic polynucleotide"
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactaccagtcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcatcaccac

SEQ ID NO: 930 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 931 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactatcaatcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggcggtgggtcagaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 932 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 933 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 934 - DNA, 828 bp, Artificial Sequence
  source: /note="Description of Artificial Sequence: Synthetic polynucleotide"
atggccctcccagtgaccgctctgctgctgcctctcgcacttcttctccatgccgctcggcctgagatcgtcatgacccaaagccccgctaccctgtccctgtcacccggcgagagggcaaccctttcatgcagggccagccaggacatttctaagtacctcaactggtatcagcagaagccagggcaggctcctcgcctgctgatctaccacaccagccgcctccacagcggtatccccgccagattttccgggagcgggtctggaaccgactacaccctcaccatctcttctctgcagcccgaggatttcgccgtctatttctgccagcaggggaatactctgccgtacaccttcggtcaaggtaccaagctggaaatcaagggaggcggaggatcaggcggtggcggaagcggaggaggtggctccggaggaggaggttcccaagtgcagcttcaagaatcaggacccggacttgtgaagccatcagaaaccctctccctgacttgtaccgtgtccggtgtgagcctccccgactacggagtctcttggattcgccagcctccggggaagggtcttgaatggattggggtgatttggggatcagagactacttactacaattcatcacttaagtcacgggtcaccatcagcaaagataatagcaagaaccaagtgtcacttaagctgtcatctgtgaccgccgctgacaccgccgtgtactattgtgccaaacattactattacggagggtcttatgctatggactactggggacaggggaccctggtgactgtctctagccatcaccatcaccaccatcatcac

SEQ ID NO: 935 - protein, 276 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 936 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagcggaggcggtgggagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 937 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 938 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 939 - DNA, 828 bp, Artificial Sequence
  source: /note="Description of Artificial Sequence: Synthetic polynucleotide"
atggcactgcctgtcactgccctcctgctgcctctggccctccttctgcatgccgccaggccccaagtccagctgcaagagtcaggacccggactggtgaagccgtctgagactctctcactgacttgtaccgtcagcggcgtgtccctccccgactacggagtgtcatggatccgccaacctcccgggaaagggcttgaatggattggtgtcatctggggttctgaaaccacctactacaactcttccctgaagtccagggtgaccatcagcaaggataattccaagaaccaggtcagccttaagctgtcatctgtgaccgctgctgacaccgccgtgtattactgcgccaagcactactattacggaggaagctacgctatggactattggggacagggcactctcgtgactgtgagcagcggcggtggagggtctggaggtggaggatccggtggtggtgggtcaggcggaggagggagcgagattgtgatgactcagtcaccagccaccctttctctttcacccggcgagagagcaaccctgagctgtagagccagccaggacatttctaagtacctcaactggtatcagcaaaaaccggggcaggcccctcgcctcctgatctaccatacctcacgccttcactctggtatccccgctcggtttagcggatcaggatctggtaccgactacactctgaccatttccagcctgcagccagaagatttcgcagtgtatttctgccagcagggcaatacccttccttacaccttcggtcagggaaccaagctcgaaatcaagcaccatcaccatcatcaccaccat

SEQ ID NO: 940 - protein, 276 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 941 - DNA, 1473 bp, Artificial Sequence; identical to SEQ ID NO: 936
  source: /note="Description of Artificial Sequence: Synthetic polynucleotide"

SEQ ID NO: 942 - protein, 491 aa, Artificial Sequence; identical to SEQ ID NO: 937
  source: /note="Description of Artificial Sequence: Synthetic polypeptide"

SEQ ID NO: 943 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 944 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaattcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 945 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 946 - DNA, 1473 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccggaggtggcggaagcgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaaaccactactcccgctccaaggccacccacccctgccccgaccatcgcctctcagccgctttccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 947 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 948 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 949 - DNA, 813 bp, Artificial Sequence
  source: /note="Description of Artificial Sequence: Synthetic polynucleotide"
atggctctgcccgtgaccgcactcctcctgccactggctctgctgcttcacgccgctcgcccacaagtccagcttcaagaatcagggcctggtctggtgaagccatctgagactctgtccctcacttgcaccgtgagcggagtgtccctcccagactacggagtgagctggattagacagcctcccggaaagggactggagtggatcggagtgatttggggtagcgaaaccacttactataactcttccctgaagtcacgggtcaccatttcaaaggataactcaaagaatcaagtgagcctcaagctctcatcagtcaccgccgctgacaccgccgtgtattactgtgccaagcattactactatggagggtcctacgccatggactactggggccagggaactctggtcactgtgtcatctggtggaggaggtagcggaggaggcgggagcggtggaggtggctccgaaatcgtgatgacccagagccctgcaaccctgtccctttctcccggggaacgggctaccctttcttgtcgggcatcacaagatatctcaaaatacctcaattggtatcaacagaagccgggacaggcccctaggcttcttatctaccacacctctcgcctgcatagcgggattcccgcacgctttagcgggtctggaagcgggaccgactacactctgaccatctcatctctccagcccgaggacttcgccgtctacttctgccagcagggtaacaccctgccgtacaccttcggccagggcaccaagcttgagatcaaacatcaccaccatcatcaccatcac

SEQ ID NO: 950 - protein, 271 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 951 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactacaactcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 952 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 953 - DNA, 813 bp, Artificial Sequence
  source: /note="Description of Artificial Sequence: Synthetic polynucleotide"
atggccctgcccgtcaccgctctgctgctgccccttgctctgcttcttcatgcagcaaggccggacatccagatgacccaaaccacctcatccctctctgcctctcttggagacagggtgaccatttcttgtcgcgccagccaggacatcagcaagtatctgaactggtatcagcagaagccggacggaaccgtgaagctcctgatctaccatacctctcgcctgcatagcggcgtgccctcacgcttctctggaagcggatcaggaaccgattattctctcactatttcaaatcttgagcaggaagatattgccacctatttctgccagcagggtaataccctgccctacaccttcggaggagggaccaagctcgaaatcaccggtggaggaggcagcggcggtggagggtctggtggaggtggttctgaggtgaagctgcaagaatcaggccctggacttgtggccccttcacagtccctgagcgtgacttgcaccgtgtccggagtctccctgcccgactacggagtgtcatggatcagacaacctccacggaaaggactggaatggctcggtgtcatctggggtagcgaaactacttactacaattcagccctcaaaagcaggctgactattatcaaggacaacagcaagtcccaagtctttcttaagatgaactcactccagactgacgacaccgcaatctactattgtgctaagcactactactacggaggatcctacgctatggattactggggacaaggtacttccgtcactgtctcttcacaccatcatcaccatcaccatcac

SEQ ID NO: 954 - protein, 271 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHHHH

SEQ ID NO: 955 - DNA, 1458 bp, Artificial Sequence
  source: /note="Description of Artificial Sequence: Synthetic polynucleotide"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 956 - protein, 486 aa, Artificial Sequence; identical to SEQ ID NO: 891
  source: /note="Description of Artificial Sequence: Synthetic polypeptide"

SEQ ID NO: 957 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 958 - protein, 5 aa, Artificial Sequence
  source: /note="Description of Artificial Sequence: Synthetic peptide"
DYGVS

SEQ ID NO: 959 - protein, 16 aa, Artificial Sequence
  source: /note="Description of Artificial Sequence: Synthetic peptide"
VIWGSETTYYNSALKS

SEQ ID NO: 960 - protein, 12 aa, Artificial Sequence
  source: /note="Description of Artificial Sequence: Synthetic peptide"
HYYYGGSYAMDY

SEQ ID NO: 961 - protein, 16 aa, Artificial Sequence
  source: /note="Description of Artificial Sequence: Synthetic peptide"
VIWGSETTYYSSSLKS

SEQ ID NO: 962 - protein, 16 aa, Artificial Sequence
  source: /note="Description of Artificial Sequence: Synthetic peptide"
VIWGSETTYYQSSLKS

SEQ ID NO: 963 - protein, 16 aa, Artificial Sequence
  source: /note="Description of Artificial Sequence: Synthetic peptide"
VIWGSETTYYNSSLKS

SEQ ID NO: 964 - protein, 11 aa, Artificial Sequence
  source: /note="Description of Artificial Sequence: Synthetic peptide"
RASQDISKYLN

SEQ ID NO: 965 - protein, 7 aa, Artificial Sequence
  source: /note="Description of Artificial Sequence: Synthetic peptide"
HTSRLHS

SEQ ID NO: 966 - protein, 9 aa, Artificial Sequence
  source: /note="Description of Artificial Sequence: Synthetic peptide"
QQGNTLPYT

SEQ ID NO: 967 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 968 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 969 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 970 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 971 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 972 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 973 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 974 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 975 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 976 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 977 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 978 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 979 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 980 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 981 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 982 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 983 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 984 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 985 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 986 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 987 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 988 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 989 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 990 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 991 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 992 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 993 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 994 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 995 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 996 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 997 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 998 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 999 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 1000 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 1001 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1002 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1003 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 1004 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 1005 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 1006 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 1007 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1008 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1009 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 1010 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 1011 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 1012 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 1013 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1014 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1015 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 1016 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 1017 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 1018 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 1019 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1020 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1021 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 1022 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 1023 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 1024 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 1025 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1026 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1027 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 1028 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 1029 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 1030 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 1031 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1032 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1033 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 1034 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 1035 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 1036 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 1037 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1038 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1039 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 1040 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 1041 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 1042 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 1043 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1044 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1045 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 1046 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 1047 - protein, 115 aa, Artificial Sequence; identical to SEQ ID NO: 1017
  source: /note="Description of Artificial Sequence: Synthetic polypeptide"

SEQ ID NO: 1048 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 1049 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1050 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1051 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 1052 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 1053 - protein, 115 aa, Artificial Sequence; identical to SEQ ID NO: 969
  source: /note="Description of Artificial Sequence: Synthetic polypeptide"

SEQ ID NO: 1054 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 1055 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1056 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1057 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 1058 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 1059 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 1060 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 1061 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1062 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1063 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 1064 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 1065 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 1066 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 1067 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1068 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1069 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 1070 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 1071 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 1072 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 1073 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1074 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1075 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 1076 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 1077 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 1078 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 1079 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1080 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1081 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 1082 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 1083 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 1084 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 1085 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1086 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1087 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 1088 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 1089 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 1090 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 1091 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1092 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1093 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 1094 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 1095 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 1096 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 1097 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1098 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1099 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 1100 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 1101 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 1102 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 1103 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1104 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1105 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 1106 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 1107 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 1108 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 1109 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1110 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1111 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 1112 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 1113 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 1114 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 1115 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1116 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1117 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 1118 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 1119 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 1120 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 1121 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1122 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1123 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 1124 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 1125 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 1126 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 1127 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1128 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1129 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 1130 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 1131 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 1132 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 1133 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1134 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1135 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 1136 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 1137 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 1138 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 1139 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1140 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1141 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 1142 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 1143 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 1144 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 1145 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1146 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1147 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 1148 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 1149 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 1150 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 1151 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1152 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1153 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 1154 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 1155 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 1156 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 1157 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1158 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1159 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 1160 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 1161 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 1162 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 1163 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1164 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1165 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 1166 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 1167 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 1168 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 1169 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1170 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1171 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 1172 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 1173 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 1174 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 1175 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1176 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1177 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 1178 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 1179 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 1180 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 1181 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1182 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1183 - protein, 122 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 1184 - protein, 107 aa, Artificial Sequence
  source: /note="Description of Artificial Sequence: Synthetic polypeptide"
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 1185 - protein, 244 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 1186 - protein, 467 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1187 - protein, 117 aa, Artificial Sequence; identical to SEQ ID NO: 425
  source: /note="Description of Artificial Sequence: Synthetic polypeptide"

SEQ ID NO: 1188 - protein, 111 aa, Artificial Sequence
  source: /note="Description of Artificial Sequence: Synthetic polypeptide"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 1189 - protein, 249 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 1190 - protein, 472 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1191 - protein, 117 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 1192 - protein, 111 aa, Artificial Sequence
  source: /note="Description of Artificial Sequence: Synthetic polypeptide"
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 1193 - protein, 243 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 1194 - protein, 466 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1195 - protein, 117 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 1196 - protein, 111 aa, Artificial Sequence; identical to SEQ ID NO: 1192
  source: /note="Description of Artificial Sequence: Synthetic polypeptide"

SEQ ID NO: 1197 - protein, 243 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 1198 - protein, 466 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1199 - protein, 5 aa, Artificial Sequence
  source: /note="Description of Artificial Sequence: Synthetic peptide"
NHGMS

SEQ ID NO: 1200 - protein, 5 aa, Artificial Sequence
  source: /note="Description of Artificial Sequence: Synthetic peptide"
NYAMS

SEQ ID NO: 1201 - protein, 5 aa, Artificial Sequence
  source: /note="Description of Artificial Sequence: Synthetic peptide"
DYAMH

SEQ ID NO: 1202 - protein, 5 aa, Artificial Sequence
  source: /note="Description of Artificial Sequence: Synthetic peptide"
NHGMS

SEQ ID NO: 1203 - protein, 5 aa, Artificial Sequence
  source: /note="Description of Artificial Sequence: Synthetic peptide"
NFGIN

SEQ ID NO: 1204 - protein, 5 aa, Artificial Sequence
  source: /note="Description of Artificial Sequence: Synthetic peptide"
SDAMT

SEQ ID NO: 1205 - protein, 5 aa, Artificial Sequence
  source: /note="Description of Artificial Sequence: Synthetic peptide"
NYGIT

SEQ ID NO: 1206 - protein, 5 aa, Artificial Sequence
  source: /note="Description of Artificial Sequence: Synthetic peptide"
NHGMS

SEQ ID NO: 1207 - protein, 5 aa, Artificial Sequence
  source: /note="Description of Artificial Sequence: Synthetic peptide"
NHGMS

SEQ ID NO: 1208 - protein, 5 aa, Artificial Sequence
  source: /note="Description of Artificial Sequence: Synthetic peptide"
NHGMS

SEQ ID NO: 1209 - protein, 5 aa, Artificial Sequence
  source: /note="Description of Artificial Sequence: Synthetic peptide"
DYYMS

SEQ ID NO: 1210 - protein, 5 aa, Artificial Sequence
  source: /note="Description of Artificial Sequence: Synthetic peptide"
DYYMS

SEQ ID NO: 1211 - protein, 5 aa, Artificial Sequence
  source: /note="Description of Artificial Sequence: Synthetic peptide"
NHGMS

SEQ ID NO: 1212 - protein, 5 aa, Artificial Sequence
  source: /note="Description of Artificial Sequence: Synthetic peptide"
NHGMS

SEQ ID NO: 1213 - protein, 5 aa, Artificial Sequence
  source: /note="Description of Artificial Sequence: Synthetic peptide"
NHGMS

SEQ ID NO: 1214 - protein, 7 aa, Artificial Sequence
  source: /note="Description of Artificial Sequence: Synthetic peptide"
SSYYYWG

SEQ ID NO: 1215 - protein, 7 aa, Artificial Sequence
  source: /note="Description of Artificial Sequence: Synthetic peptide"
TSGMCVS

SEQ ID NO: 1216 - protein, 5 aa, Artificial Sequence
  source: /note="Description of Artificial Sequence: Synthetic peptide"
SYSMN

SEQ ID NO: 1217 - protein, 5 aa, Artificial Sequence
  source: /note="Description of Artificial Sequence: Synthetic peptide"
DYYMS

SEQ ID NO: 1218 - protein, 5 aa, Artificial Sequence
  source: /note="Description of Artificial Sequence: Synthetic peptide"
SHYIH

SEQ ID NO: 1219 - protein, 7 aa, Artificial Sequence
  source: /note="Description of Artificial Sequence: Synthetic peptide"
SGGYYWS

SEQ ID NO: 1220 - protein, 5 aa, Artificial Sequence
  source: /note="Description of Artificial Sequence: Synthetic peptide"
SYAIS

SEQ ID NO: 1221 - protein, 7 aa, Artificial Sequence
  source: /note="Description of Artificial Sequence: Synthetic peptide"
SNSAAWN

SEQ ID NO: 1222 - protein, 5 aa, Artificial Sequence
  source: /note="Description of Artificial Sequence: Synthetic peptide"
SYAMS

SEQ ID NO: 1223 - protein, 5 aa, Artificial Sequence
  source: /note="Description of Artificial Sequence: Synthetic peptide"
RYPMS

SEQ ID NO: 1224 - protein, 5 aa, Artificial Sequence
  source: /note="Description of Artificial Sequence: Synthetic peptide"
SYAMS

SEQ ID NO: 1225 - protein, 5 aa, Artificial Sequence
  source: /note="Description of Artificial Sequence: Synthetic peptide"
SYAMS

SEQ ID NO: 1226 - protein, 5 aa, Artificial Sequence
  source: /note="Description of Artificial Sequence: Synthetic peptide"
DYAMH

SEQ ID NO: 1227 - protein, 5 aa, Artificial Sequence
  source: /note="Description of Artificial Sequence: Synthetic peptide"
DYAMH

SEQ ID NO: 1228 - protein, 5 aa, Artificial Sequence
  source: /note="Description of Artificial Sequence: Synthetic peptide"
SYAMS

SEQ ID NO: 1229 - protein, 5 aa, Artificial Sequence
  source: /note="Description of Artificial Sequence: Synthetic peptide"
SYAMS

SEQ ID NO: 1230 - protein, 5 aa, Artificial Sequence
  source: /note="Description of Artificial Sequence: Synthetic peptide"
SYAMS

SEQ ID NO: 1231 - protein, 5 aa, Artificial Sequence
  source: /note="Description of Artificial Sequence: Synthetic peptide"
SYAMS

SEQ ID NO: 1232 - protein, 5 aa, Artificial Sequence
  source: /note="Description of Artificial Sequence: Synthetic peptide"
SYAMS

SEQ ID NO: 1233 - protein, 5 aa, Artificial Sequence
  source: /note="Description of Artificial Sequence: Synthetic peptide"
SYAMS

SEQ ID NO: 1234 - protein, 5 aa, Artificial Sequence
  source: /note="Description of Artificial Sequence: Synthetic peptide"
SYAMS

SEQ ID NO: 1235 - protein, 5 aa, Artificial Sequence
  source: /note="Description of Artificial Sequence: Synthetic peptide"
NFGMN

SEQ ID NO: 1236 - protein, 5 aa, Artificial Sequence
  source: /note="Description of Artificial Sequence: Synthetic peptide"
DYSIN

SEQ ID NO: 1237 - protein, 5 aa, Artificial Sequence
  source: /note="Description of Artificial Sequence: Synthetic peptide"
HYSMN

SEQ ID NO: 1238 - protein, 5 aa, Artificial Sequence
  source: /note="Description of Artificial Sequence: Synthetic peptide"
HYSMN

SEQ ID NO: 1239 - protein, 16 aa, Artificial Sequence
  source: /note="Description of Artificial Sequence: Synthetic peptide"
GIVYSGSTYYAASVKG

SEQ ID NO: 1240 - protein, 17 aa, Artificial Sequence
  source: /note="Description of Artificial Sequence: Synthetic peptide"
GISRSGENTYYADSVKG

SEQ ID NO: 1241 - protein, 17 aa, Artificial Sequence
  source: /note="Description of Artificial Sequence: Synthetic peptide"
GISWNSGSIGYADSVKG

SEQ ID NO: 1242 - protein, 16 aa, Artificial Sequence
  source: /note="Description of Artificial Sequence: Synthetic peptide"
GIVYSGSTYYAASVKG

SEQ ID NO: 1243 - protein, 17 aa, Artificial Sequence
  source: /note="Description of Artificial Sequence: Synthetic peptide"
WINPKNNNTNYAQKFQG

SEQ ID NO: 1244 - protein, 17 aa, Artificial Sequence
  source: /note="Description of Artificial Sequence: Synthetic peptide"
VISGSGGTTYYADSVKG

SEQ ID NO: 1245 - protein, 17 aa, Artificial Sequence
  source: /note="Description of Artificial Sequence: Synthetic peptide"
WISAYNGNTNYAQKFQG

SEQ ID NO: 1246 - protein, 16 aa, Artificial Sequence
  source: /note="Description of Artificial Sequence: Synthetic peptide"
GIVYSGSTYYAASVKG

SEQ ID NO: 1247 - protein, 16 aa, Artificial Sequence
  source: /note="Description of Artificial Sequence: Synthetic peptide"
GIVYSGSTYYAASVKG

SEQ ID NO: 1248 - protein, 16 aa, Artificial Sequence
  source: /note="Description of Artificial Sequence: Synthetic peptide"
GIVYSGSTYYAASVKG

SEQ ID NO: 1249 - protein, 17 aa, Artificial Sequence
  source: /note="Description of Artificial Sequence: Synthetic peptide"
YISSSGSTIYYADSVKG

SEQ ID NO: 1250 - protein, 17 aa, Artificial Sequence
  source: /note="Description of Artificial Sequence: Synthetic peptide"
YISSSGNTIYYADSVKG

SEQ ID NO: 1251 - protein, 16 aa, Artificial Sequence
  source: /note="Description of Artificial Sequence: Synthetic peptide"
GIVYSGSTYYAASVKG

SEQ ID NO: 1252 - protein, 16 aa, Artificial Sequence
  source: /note="Description of Artificial Sequence: Synthetic peptide"
GIVYSGSTYYAASVKG

SEQ ID NO: 1253 - protein, 16 aa, Artificial Sequence
  source: /note="Description of Artificial Sequence: Synthetic peptide"
GIVYSGSTYYAASVKG

SEQ ID NO: 1254 - protein, 16 aa, Artificial Sequence
  source: /note="Description of Artificial Sequence: Synthetic peptide"
SIYYSGSAYYNPSLKS

SEQ ID NO: 1255 - protein, 16 aa, Artificial Sequence
  source: /note="Description of Artificial Sequence: Synthetic peptide"
RIDWDEDKFYSTSLKT

SEQ ID NO: 1256 - protein, 17 aa, Artificial Sequence
  source: /note="Description of Artificial Sequence: Synthetic peptide"
SISSSSSYIYYADSVKG

SEQ ID NO: 1257 - protein, 17 aa, Artificial Sequence
  source: /note="Description of Artificial Sequence: Synthetic peptide"
YISSSGSTIYYADSVKG

SEQ ID NO: 1258 - protein, 17 aa, Artificial Sequence
  source: /note="Description of Artificial Sequence: Synthetic peptide"
MINPSGGVTAYSQTLQG

SEQ ID NO: 1259 - protein, 16 aa, Artificial Sequence
  source: /note="Description of Artificial Sequence: Synthetic peptide"
YIYYSGSTYYNPSLKS

SEQ ID NO: 1260 - protein, 17 aa, Artificial Sequence
  source: /note="Description of Artificial Sequence: Synthetic peptide"
GIIPIFGTANYAQKFQG

SEQ ID NO: 1261 - protein, 18 aa, Artificial Sequence
  source: /note="Description of Artificial Sequence: Synthetic peptide"
RTYYRSKWYSFYAISLKS

SEQ ID NO: 1262 - protein, 17 aa, Artificial Sequence
  source: /note="Description of Artificial Sequence: Synthetic peptide"
AISGSGGSTYYADSVKG

SEQ ID NO: 1263 - protein, 17 aa, Artificial Sequence
  source: /note="Description of Artificial Sequence: Synthetic peptide"
GISDSGVSTYYADSAKG

SEQ ID NO: 1264 - protein, 17 aa, Artificial Sequence
  source: /note="Description of Artificial Sequence: Synthetic peptide"
AISGSGGSTYYADSVKG

SEQ ID NO: 1265 - protein, 17 aa, Artificial Sequence
  source: /note="Description of Artificial Sequence: Synthetic peptide"
AISGSGGSTYYADSVKG

SEQ ID NO: 1266 - protein, 17 aa, Artificial Sequence
  source: /note="Description of Artificial Sequence: Synthetic peptide"
GISWNSGSIGYADSVKG

SEQ ID NO: 1267 - protein, 17 aa, Artificial Sequence
  source: /note="Description of Artificial Sequence: Synthetic peptide"
SINWKGNSLAYGDSVKG

SEQ ID NO: 1268 - protein, 17 aa, Artificial Sequence
  source: /note="Description of Artificial Sequence: Synthetic peptide"
AISGSGGSTYYADSVKG

SEQ ID NO: 1269 - protein, 17 aa, Artificial Sequence
  source: /note="Description of Artificial Sequence: Synthetic peptide"
AISGSGGSTYYADSVKG

SEQ ID NO: 1270 - protein, 17 aa, Artificial Sequence
  source: /note="Description of Artificial Sequence: Synthetic peptide"
AISGSGGSTYYADSVKG

SEQ ID NO: 1271 - protein, 17 aa, Artificial Sequence
  source: /note="Description of Artificial Sequence: Synthetic peptide"
AISGSGGSTYYADSVKG

SEQ ID NO: 1272 - protein, 17 aa, Artificial Sequence
  source: /note="Description of Artificial Sequence: Synthetic peptide"
AISGSGGSTYYADSVKG

SEQ ID NO: 1273 - protein, 17 aa, Artificial Sequence
  source: /note="Description of Artificial Sequence: Synthetic peptide"
AISGSGGSTYYADSVKG

SEQ ID NO: 1274 - protein, 17 aa, Artificial Sequence
  source: /note="Description of Artificial Sequence: Synthetic peptide"
AISGSGGSTYYADSVKG

SEQ ID NO: 1275 - protein, 17 aa, Artificial Sequence
  source: /note="Description of Artificial Sequence: Synthetic peptide"
WINTYTGESYFADDFKG

SEQ ID NO: 1276 - protein, 17 aa, Artificial Sequence
  source: /note="Description of Artificial Sequence: Synthetic peptide"
WINTETREPAYAYDFRG

SEQ ID NO: 1277 - protein, 17 aa, Artificial Sequence
  source: /note="Description of Artificial Sequence: Synthetic peptide"
RINTESGVPIYADDFKG

SEQ ID NO: 1278 - protein, 17 aa, Artificial Sequence
  source: /note="Description of Artificial Sequence: Synthetic peptide"
RINTETGEPLYADDFKG

SEQ ID NO: 1279 - protein, 7 aa, Artificial Sequence
  source: /note="Description of Artificial Sequence: Synthetic peptide"
HGGESDV

SEQ ID NO: 1280 - protein, 11 aa, Artificial Sequence
  source: /note="Description of Artificial Sequence: Synthetic peptide"
SPAHYYGGMDV

SEQ ID NO: 1281 - protein, 6 aa, Artificial Sequence
  source: /note="Description of Artificial Sequence: Synthetic peptide"
HSFLAY

SEQ ID NO: 1282 - protein, 7 aa, Artificial Sequence
  source: /note="Description of Artificial Sequence: Synthetic peptide"
HGGESDV

SEQ ID NO: 1283 - protein, 11 aa, Artificial Sequence
  source: /note="Description of Artificial Sequence: Synthetic peptide"
GPYYYQSYMDV

SEQ ID NO: 1284 - protein, 14 aa, Artificial Sequence
  source: /note="Description of Artificial Sequence: Synthetic peptide"
LDSSGYYYARGPRY

SEQ ID NO: 1285 - protein, 9 aa, Artificial Sequence
  source: /note="Description of Artificial Sequence: Synthetic peptide"
GPYYYYMDV

SEQ ID NO: 1286 - protein, 7 aa, Artificial Sequence
  source: /note="Description of Artificial Sequence: Synthetic peptide"
HGGESDV

SEQ ID NO: 1287 - protein, 7 aa, Artificial Sequence
  source: /note="Description of Artificial Sequence: Synthetic peptide"
HGGESDV

SEQ ID NO: 1288 - protein, 7 aa, Artificial Sequence
  source: /note="Description of Artificial Sequence: Synthetic peptide"
HGGESDV

SEQ ID NO: 1289 - protein, 8 aa, Artificial Sequence
  source: /note="Description of Artificial Sequence: Synthetic peptide"
ESGDGMDV

SEQ ID NO: 1290 - protein, 8 aa, Artificial Sequence
  source: /note="Description of Artificial Sequence: Synthetic peptide"
STMVREDY

SEQ ID NO: 1291 - protein, 7 aa, Artificial Sequence
  source: /note="Description of Artificial Sequence: Synthetic peptide"
HGGESDV

SEQ ID NO: 1292 - protein, 7 aa, Artificial Sequence
  source: /note="Description of Artificial Sequence: Synthetic peptide"
HGGESDV

SEQ ID NO: 1293 - protein, 7 aa, Artificial Sequence
  source: /note="Description of Artificial Sequence: Synthetic peptide"
HGGESDV

SEQ ID NO: 1294 - protein, 11 aa, Artificial Sequence
  source: /note="Description of Artificial Sequence: Synthetic peptide"
HWQEWPDAFDI

SEQ ID NO: 1295 - protein, 13 aa, Artificial Sequence
  source: /note="Description of Artificial Sequence: Synthetic peptide"
SGAGGTSATAFDI

SEQ ID NO: 1296 - protein, 10 aa, Artificial Sequence
  source: /note="Description of Artificial Sequence: Synthetic peptide"
TIAAVYAFDI

SEQ ID NO: 1297 - protein, 8 aa, Artificial Sequence
  source: /note="Description of Artificial Sequence: Synthetic peptide"
DLRGAFDI

SEQ ID NO: 1298 - protein, 11 aa, Artificial Sequence
  source: /note="Description of Artificial Sequence: Synthetic peptide"
EGSGSGWYFDF

SEQ ID NO: 1299 - protein, 13 aa, Artificial Sequence
  source: /note="Description of Artificial Sequence: Synthetic peptide"
AGIAARLRGAFDI

SEQ ID NO: 1300 - protein, 20 aa, Artificial Sequence
  source: /note="Description of Artificial Sequence: Synthetic peptide"
RGGYQLLRWDVGLLRSAFDI

SEQ ID NO: 1301 - protein, 13 aa, Artificial Sequence
  source: /note="Description of Artificial Sequence: Synthetic peptide"
SSPEGLFLYWFDP

SEQ ID NO: 1302 - protein, 9 aa, Artificial Sequence
  source: /note="Description of Artificial Sequence: Synthetic peptide"
VEGSGSLDY

SEQ ID NO: 1303 - protein, 9 aa, Artificial Sequence
  source: /note="Description of Artificial Sequence: Synthetic peptide"
RAGSEASDI

SEQ ID NO: 1304 - protein, 15 aa, Artificial Sequence
  source: /note="Description of Artificial Sequence: Synthetic peptide"
ATYKRELRYYYGMDV

SEQ ID NO: 1305 - protein, 15 aa, Artificial Sequence
  source: /note="Description of Artificial Sequence: Synthetic peptide"
ATYKRELRYYYGMDV

SEQ ID NO: 1306 - protein, 8 aa, Artificial Sequence
  source: /note="Description of Artificial Sequence: Synthetic peptide"
VGKAVPDV

SEQ ID NO: 1307 - protein, 13 aa, Artificial Sequence
  source: /note="Description of Artificial Sequence: Synthetic peptide"
HQGVAYYNYAMDV

SEQ ID NO: 1308 - protein, 8 aa, Artificial Sequence
  source: /note="Description of Artificial Sequence: Synthetic peptide"
VVRDGMDV

SEQ ID NO: 1309 - protein, 9 aa, Artificial Sequence
  source: /note="Description of Artificial Sequence: Synthetic peptide"
IPQTGTFDY

SEQ ID NO: 1310 - protein, 15 aa, Artificial Sequence
  source: /note="Description of Artificial Sequence: Synthetic peptide"
ANYKRELRYYYGMDV

SEQ ID NO: 1311 - protein, 11 aa, Artificial Sequence
  source: /note="Description of Artificial Sequence: Synthetic peptide"
ALVGATGAFDI

SEQ ID NO: 1312 - protein, 8 aa, Artificial Sequence
  source: /note="Description of Artificial Sequence: Synthetic peptide"
WFGEGFDP

SEQ ID NO: 1313 - protein, 17 aa, Artificial Sequence
  source: /note="Description of Artificial Sequence: Synthetic peptide"
VGYDSSGYYRDYYGMDV

SEQ ID NO: 1314 - protein, 13 aa, Artificial Sequence
  source: /note="Description of Artificial Sequence: Synthetic peptide"
MGWSSGYLGAFDI

SEQ ID NO: 1315 - protein, 13 aa, Artificial Sequence
  source: /note="Description of Artificial Sequence: Synthetic peptide"
GEIYYGYDGGFAY

SEQ ID NO: 1316 - protein, 8 aa, Artificial Sequence
  source: /note="Description of Artificial Sequence: Synthetic peptide"
DYSYAMDY

SEQ ID NO: 1317 - protein, 8 aa, Artificial Sequence
  source: /note="Description of Artificial Sequence: Synthetic peptide"
DYLYSLDF

SEQ ID NO: 1318 - protein, 8 aa, Artificial Sequence
  source: /note="Description of Artificial Sequence: Synthetic peptide"
DYLYSCDY

SEQ ID NO: 1319 - protein, 11 aa, Artificial Sequence
  source: /note="Description of Artificial Sequence: Synthetic peptide"
RASQSISSYLN

SEQ ID NO: 1320 - protein, 12 aa, Artificial Sequence
  source: /note="Description of Artificial Sequence: Synthetic peptide"
RASQSISSSFLA

SEQ ID NO: 1321 - protein, 16 aa, Artificial Sequence
  source: /note="Description of Artificial Sequence: Synthetic peptide"
RSSQSLLHSNGYNYLD

SEQ ID NO: 1322 - protein, 16 aa, Artificial Sequence
  source: /note="Description of Artificial Sequence: Synthetic peptide"
KSSQSLLRNDGKTPLY

SEQ ID NO: 1323 - protein, 16 aa, Artificial Sequence
  source: /note="Description of Artificial Sequence: Synthetic peptide"
RSSQSLLHSNGYNYLN

SEQ ID NO: 1324 - protein, 11 aa, Artificial Sequence
  source: /note="Description of Artificial Sequence: Synthetic peptide"
RASQSISSYLN

SEQ ID NO: 1325 - protein, 16 aa, Artificial Sequence
  source: /note="Description of Artificial Sequence: Synthetic peptide"
RSSQSLLYSNGYNYVD

SEQ ID NO: 1326 - protein, 11 aa, Artificial Sequence
  source: /note="Description of Artificial Sequence: Synthetic peptide"
RASQSVSSNLA

SEQ ID NO: 1327 - protein, 11 aa, Artificial Sequence
  source: /note="Description of Artificial Sequence: Synthetic peptide"
RASQSVSSKLA

SEQ ID NO: 1328 - protein, 12 aa, Artificial Sequence
  source: /note="Description of Artificial Sequence: Synthetic peptide"
RASQSVGSTNLA

SEQ ID NO: 1329 - protein, 11 aa, Artificial Sequence
  source: /note="Description of Artificial Sequence: Synthetic peptide"
RASQSISSYLN

SEQ ID NO: 1330 - protein, 16 aa, Artificial Sequence
  source: /note="Description of Artificial Sequence: Synthetic peptide"
KSSESLVHNSGKTYLN

SEQ ID NO: 1331 - protein, 11 aa, Artificial Sequence
  source: /note="Description of Artificial Sequence: Synthetic peptide"
QASEDINKFLN

SEQ ID NO: 1332 - protein, 11 aa, Artificial Sequence
  source: /note="Description of Artificial Sequence: Synthetic peptide"
RASQSVGSNLA

SEQ ID NO: 1333 - protein, 12 aa, Artificial Sequence
  source: /note="Description of Artificial Sequence: Synthetic peptide"
RASQSIGSSSLA

SEQ ID NO: 1334 - protein, 11 aa, Artificial Sequence
  source: /note="Description of Artificial Sequence: Synthetic peptide"
KASQDIDDAMN

SEQ ID NO: 1335 - protein, 11 aa, Artificial Sequence
  source: /note="Description of Artificial Sequence: Synthetic peptide"
RASQDIYNNLA

SEQ ID NO: 1336 - protein, 16 aa, Artificial Sequence
  source: /note="Description of Artificial Sequence: Synthetic peptide"
RSSQSLLHSNGYNYLD

SEQ ID NO: 1337 - protein, 11 aa, Artificial Sequence
  source: /note="Description of Artificial Sequence: Synthetic peptide"
GGNNIGTKSVH

SEQ ID NO: 1338 - protein, 11 aa, Artificial Sequence
  source: /note="Description of Artificial Sequence: Synthetic peptide"
SGDGLSKKYVS

SEQ ID NO: 1339 - protein, 11 aa, Artificial Sequence
  source: /note="Description of Artificial Sequence: Synthetic peptide"
RASQGIRNWLA

SEQ ID NO: 1340 - protein, 11 aa, Artificial Sequence
  source: /note="Description of Artificial Sequence: Synthetic peptide"
GGNNIGSKSVH

SEQ ID NO: 1341 - protein, 11 aa, Artificial Sequence
  source: /note="Description of Artificial Sequence: Synthetic peptide"
QGDSLGNYYAT

SEQ ID NO: 1342 - protein, 12 aa, Artificial Sequence
  source: /note="Description of Artificial Sequence: Synthetic peptide"
RASQSVSSAYLA

SEQ ID NO: 1343 - protein, 11 aa, Artificial Sequence
  source: /note="Description of Artificial Sequence: Synthetic peptide"
RASQSVSNSLA

SEQ ID NO: 1344 - protein, 12 aa, Artificial Sequence
  source: /note="Description of Artificial Sequence: Synthetic peptide"
RASQSVSSSFLA

SEQ ID NO: 1345 - protein, 12 aa, Artificial Sequence
  source: /note="Description of Artificial Sequence: Synthetic peptide"
RASQSVSTTFLA

SEQ ID NO: 1346 - protein, 11 aa, Artificial Sequence
  source: /note="Description of Artificial Sequence: Synthetic peptide"
RASQSISSYLN

SEQ ID NO: 1347 - protein, 12 aa, Artificial Sequence
  source: /note="Description of Artificial Sequence: Synthetic peptide"
RATQSIGSSFLA

SEQ ID NO: 1348 - protein, 12 aa, Artificial Sequence
  source: /note="Description of Artificial Sequence: Synthetic peptide"
RASQSVSSSYLA

SEQ ID NO: 1349 - protein, 12 aa, Artificial Sequence
  source: /note="Description of Artificial Sequence: Synthetic peptide"
RASQSVSSSYLA

SEQ ID NO: 1350 - protein, 12 aa, Artificial Sequence
  source: /note="Description of Artificial Sequence: Synthetic peptide"
RASQRVASNYLA

SEQ ID NO: 1351 - protein, 12 aa, Artificial Sequence
  source: /note="Description of Artificial Sequence: Synthetic peptide"
RASQSLSSNFLA

SEQ ID NO: 1352 - protein, 16 aa, Artificial Sequence
  source: /note="Description of Artificial Sequence: Synthetic peptide"
RSSQSLLHSNGYNYLD

SEQ ID NO: 1353 - protein, 12 aa, Artificial Sequence
  source: /note="Description of Artificial Sequence: Synthetic peptide"
RASQSVSSSYLA

SEQ ID NO: 1354 - protein, 12 aa, Artificial Sequence
  source: /note="Description of Artificial Sequence: Synthetic peptide"
RASQSVASSFLA

SEQ ID NO: 1355 - protein, 11 aa, Artificial Sequence
  source: /note="Description of Artificial Sequence: Synthetic peptide"
RASQDVNTAVS

SEQ ID NO: 1356 - protein, 15 aa, Artificial Sequence
  source: /note="Description of Artificial Sequence: Synthetic peptide"
RASESVSVIGAHLIH

SEQ ID NO: 1357 - protein, 15 aa, Artificial Sequence
  source: /note="Description of Artificial Sequence: Synthetic peptide"
RASESVTILGSHLIY

SEQ ID NO: 1358 - protein, 15 aa, Artificial Sequence
  source: /note="Description of Artificial Sequence: Synthetic peptide"
RASESVTILGSHLIY

SEQ ID NO: 1359 - protein, 7 aa, Artificial Sequence
  source: /note="Description of Artificial Sequence: Synthetic peptide"
AASSLQS

SEQ ID NO: 1360 - protein, 7 aa, Artificial Sequence
  source: /note="Description of Artificial Sequence: Synthetic peptide"
GASRRAT

SEQ ID NO: 1361 - protein, 7 aa, Artificial Sequence
  source: /note="Description of Artificial Sequence: Synthetic peptide"
LGSNRAS

SEQ ID NO: 1362 - protein, 7 aa, Artificial Sequence
  source: /note="Description of Artificial Sequence: Synthetic peptide"
EVSNRFS

SEQ ID NO: 1363 - protein, 7 aa, Artificial Sequence
  source: /note="Description of Artificial Sequence: Synthetic peptide"
LGSKRAS

SEQ ID NO: 1364 - protein, 7 aa, Artificial Sequence
  source: /note="Description of Artificial Sequence: Synthetic peptide"
GASTLAS

SEQ ID NO: 1365 - protein, 7 aa, Artificial Sequence
  source: /note="Description of Artificial Sequence: Synthetic peptide"
LGSNRAS

SEQ ID NO: 1366 - protein, 7 aa, Artificial Sequence
  source: /note="Description of Artificial Sequence: Synthetic peptide"
GASTRAS

SEQ ID NO: 1367 - protein, 7 aa, Artificial Sequence
  source: /note="Description of Artificial Sequence: Synthetic peptide"
GASIRAT

SEQ ID NO: 1368 - protein, 7 aa, Artificial Sequence
  source: /note="Description of Artificial Sequence: Synthetic peptide"
DASNRAT

SEQ ID NO: 1369 - protein, 7 aa, Artificial Sequence
  source: /note="Description of Artificial Sequence: Synthetic peptide"
AASSLQS

SEQ ID NO: 1370 - protein, 7 aa, Artificial Sequence
  source: /note="Description of Artificial Sequence: Synthetic peptide"
EVSNRDS

SEQ ID NO: 1371 - protein, 7 aa, Artificial Sequence
  source: /note="Description of Artificial Sequence: Synthetic peptide"
DASTLQT

SEQ ID NO: 1372 - protein, 7 aa, Artificial Sequence
  source: /note="Description of Artificial Sequence: Synthetic peptide"
GASTRAT

SEQ ID NO: 1373 - protein, 7 aa, Artificial Sequence
  source: /note="Description of Artificial Sequence: Synthetic peptide"
GASSRAS

SEQ ID NO: 1374 - protein, 7 aa, Artificial Sequence
  source: /note="Description of Artificial Sequence: Synthetic peptide"
SATSPVP

SEQ ID NO: 1375 - protein, 7 aa, Artificial Sequence
  source: /note="Description of Artificial Sequence: Synthetic peptide"
AANKSQS

SEQ ID NO: 1376 - protein, 7 aa, Artificial Sequence
  source: /note="Description of Artificial Sequence: Synthetic peptide"
LGSNRAS

SEQ ID NO: 1377 - protein, 7 aa, Artificial Sequence
  source: /note="Description of Artificial Sequence: Synthetic peptide"
DDSVRPS

SEQ ID NO: 1378 - protein, 7 aa, Artificial Sequence
  source: /note="Description of Artificial Sequence: Synthetic peptide"
RDKERPS

SEQ ID NO: 1379 - protein, 7 aa, Artificial Sequence
  source: /note="Description of Artificial Sequence: Synthetic peptide"
AASNLQS

SEQ ID NO: 1380 - protein, 7 aa, Artificial Sequence
  source: /note="Description of Artificial Sequence: Synthetic peptide"
GKNNRPS

SEQ ID NO: 1381 - protein, 7 aa, Artificial Sequence
  source: /note="Description of Artificial Sequence: Synthetic peptide"
GTNNRPS

SEQ ID NO: 1382 - protein, 7 aa, Artificial Sequence
  source: /note="Description of Artificial Sequence: Synthetic peptide"
GASTRAT

SEQ ID NO: 1383 - protein, 7 aa, Artificial Sequence
  source: /note="Description of Artificial Sequence: Synthetic peptide"
DASSRAT

SEQ ID NO: 1384 - protein, 7 aa, Artificial Sequence
  source: /note="Description of Artificial Sequence: Synthetic peptide"
GASSRAT

SEQ ID NO: 1385 - protein, 7 aa, Artificial Sequence
  source: /note="Description of Artificial Sequence: Synthetic peptide"
GSSNRAT

SEQ ID NO: 1386 - protein, 7 aa, Artificial Sequence
  source: /note="Description of Artificial Sequence: Synthetic peptide"
AASSLQS

SEQ ID NO: 1387 - protein, 7 aa, Artificial Sequence
  source: /note="Description of Artificial Sequence: Synthetic peptide"
GASQRAT

SEQ ID NO: 1388 - protein, 7 aa, Artificial Sequence
  source: /note="Description of Artificial Sequence: Synthetic peptide"
GASSRAT

SEQ ID NO: 1389 - protein, 7 aa, Artificial Sequence
  source: /note="Description of Artificial Sequence: Synthetic peptide"
GASSRAT

SEQ ID NO: 1390 - protein, 7 aa, Artificial Sequence
  source: /note="Description of Artificial Sequence: Synthetic peptide"
GASSRAT

SEQ ID NO: 1391 - protein, 7 aa, Artificial Sequence
  source: /note="Description of Artificial Sequence: Synthetic peptide"
GASNWAT

SEQ ID NO: 1392 - protein, 7 aa, Artificial Sequence
  source: /note="Description of Artificial Sequence: Synthetic peptide"
LGSNRAS

SEQ ID NO: 1393 - protein, 7 aa, Artificial Sequence
  source: /note="Description of Artificial Sequence: Synthetic peptide"
GTSSRAT

SEQ ID NO: 1394 - protein, 7 aa, Artificial Sequence
  source: /note="Description of Artificial Sequence: Synthetic peptide"
GASGRAT

SEQ ID NO: 1395 - protein, 7 aa, Artificial Sequence
  source: /note="Description of Artificial Sequence: Synthetic peptide"
SASYRYT

SEQ ID NO: 1396 - protein, 7 aa, Artificial Sequence
  source: /note="Description of Artificial Sequence: Synthetic peptide"
LASNLET

SEQ ID NO: 1397 - protein, 7 aa, Artificial Sequence
  source: /note="Description of Artificial Sequence: Synthetic peptide"
LASNVQT

SEQ ID NO: 1398 - protein, 7 aa, Artificial Sequence
  source: /note="Description of Artificial Sequence: Synthetic peptide"
LASNVQT

SEQ ID NO: 1399 - protein, 9 aa, Artificial Sequence
  source: /note="Description of Artificial Sequence: Synthetic peptide"
QQSYSTPYT

SEQ ID NO: 1400 - protein, 10 aa, Artificial Sequence
  source: /note="Description of Artificial Sequence: Synthetic peptide"
QQYHSSPSWT

SEQ ID NO: 1401 - protein, 9 aa, Artificial Sequence
  source: /note="Description of Artificial Sequence: Synthetic peptide"
MQALQTPYT

SEQ ID NO: 1402 - protein, 8 aa, Artificial Sequence
  source: /note="Description of Artificial Sequence: Synthetic peptide"
MQNIQFPS

SEQ ID NO: 1403 - protein, 9 aa, Artificial Sequence
  source: /note="Description of Artificial Sequence: Synthetic peptide"
MQALQTPYT

SEQ ID NO: 1404 - protein, 8 aa, Artificial Sequence
  source: /note="Description of Artificial Sequence: Synthetic peptide"
QQSYKRAS

SEQ ID NO: 1405 - protein, 9 aa, Artificial Sequence
  source: /note="Description of Artificial Sequence: Synthetic peptide"
MQGRQFPYS

SEQ ID NO: 1406 - protein, 8 aa, Artificial Sequence
  source: /note="Description of Artificial Sequence: Synthetic peptide"
QQYGSSLT

SEQ ID NO: 1407 - protein, 9 aa, Artificial Sequence
  source: /note="Description of Artificial Sequence: Synthetic peptide"
QQYGSSSWT

SEQ ID NO: 1408 - protein, 10 aa, Artificial Sequence
  source: /note="Description of Artificial Sequence: Synthetic peptide"
QQYGSSPPWT

SEQ ID NO: 1409 - protein, 7 aa, Artificial Sequence
  source: /note="Description of Artificial Sequence: Synthetic peptide"
QQSYTLA

SEQ ID NO: 1410 - protein, 9 aa, Artificial Sequence
  source: /note="Description of Artificial Sequence: Synthetic peptide"
MQGTHWPGT

SEQ ID NO: 1411 - protein, 9 aa, Artificial Sequence
  source: /note="Description of Artificial Sequence: Synthetic peptide"
QQYESLPLT

SEQ ID NO: 1412 - protein, 10 aa, Artificial Sequence
  source: /note="Description of Artificial Sequence: Synthetic peptide"
QQYNDWLPVT

SEQ ID NO: 1413 - protein, 10 aa, Artificial Sequence
  source: /note="Description of Artificial Sequence: Synthetic peptide"
QQYAGSPPFT

SEQ ID NO: 1414 - protein, 9 aa, Artificial Sequence
  source: /note="Description of Artificial Sequence: Synthetic peptide"
LQHDNFPLT

SEQ ID NO: 1415 - protein, 9 aa, Artificial Sequence
  source: /note="Description of Artificial Sequence: Synthetic peptide"
QHYYRFPYS

SEQ ID NO: 1416 - protein, 9 aa, Artificial Sequence
  source: /note="Description of Artificial Sequence: Synthetic peptide"
MQALQTPYT

SEQ ID NO: 1417 - protein, 11 aa, Artificial Sequence
  source: /note="Description of Artificial Sequence: Synthetic peptide"
QVWDSDSEHVV

SEQ ID NO: 1418 - protein, 9 aa, Artificial Sequence
  source: /note="Description of Artificial Sequence: Synthetic peptide"
QAWDDTTVV

SEQ ID NO: 1419 - protein, 9 aa, Artificial Sequence
  source: /note="Description of Artificial Sequence: Synthetic peptide"
QKYNSAPFT

SEQ ID NO: 1420 - protein, 12 aa, Artificial Sequence
  source: /note="Description of Artificial Sequence: Synthetic peptide"
SSRDSSGDHLRV

SEQ ID NO: 1421 - protein, 11 aa, Artificial Sequence
  source: /note="Description of Artificial Sequence: Synthetic peptide"
NSRDSSGHHLL

SEQ ID NO: 1422 - protein, 14 aa, Artificial Sequence
  source: /note="Description of Artificial Sequence: Synthetic peptide"
QHYGSSFNGSSLFT

SEQ ID NO: 1423 - protein, 10 aa, Artificial Sequence
  source: /note="Description of Artificial Sequence: Synthetic peptide"
QQFGTSSGLT

SEQ ID NO: 1424 - protein, 10 aa, Artificial Sequence
  source: /note="Description of Artificial Sequence: Synthetic peptide"
QQYHSSPSWT

SEQ ID NO: 1425 - protein, 10 aa, Artificial Sequence
  source: /note="Description of Artificial Sequence: Synthetic peptide"
QQYHSSPSWT

SEQ ID NO: 1426 - protein, 9 aa, Artificial Sequence
  source: /note="Description of Artificial Sequence: Synthetic peptide"
QQSYSTPYS

SEQ ID NO: 1427 - protein, 10 aa, Artificial Sequence
  source: /note="Description of Artificial Sequence: Synthetic peptide"
QHYESSPSWT

SEQ ID NO: 1428 - protein, 10 aa, Artificial Sequence
  source: /note="Description of Artificial Sequence: Synthetic peptide"
QQYGSPPRFT

SEQ ID NO: 1429 - protein, 10 aa, Artificial Sequence
  source: /note="Description of Artificial Sequence: Synthetic peptide"
QHYGSSPSWT

SEQ ID NO: 1430 - protein, 10 aa, Artificial Sequence
  source: /note="Description of Artificial Sequence: Synthetic peptide"
QHYDSSPSWT

SEQ ID NO: 1431 - protein, 10 aa, Artificial Sequence
  source: /note="Description of Artificial Sequence: Synthetic peptide"
QYYGTSPMYT

SEQ ID NO: 1432 - protein, 9 aa, Artificial Sequence
  source: /note="Description of Artificial Sequence: Synthetic peptide"
MQALQTPLT

SEQ ID NO: 1433 - protein, 11 aa, Artificial Sequence
  source: /note="Description of Artificial Sequence: Synthetic peptide"
QHYGNSPPKFT

SEQ ID NO: 1434 - protein, 10 aa, Artificial Sequence
  source: /note="Description of Artificial Sequence: Synthetic peptide"
QHYGGSPRLT

SEQ ID NO: 1435 - protein, 9 aa, Artificial Sequence
  source: /note="Description of Artificial Sequence: Synthetic peptide"
QQHYSTPWT

SEQ ID NO: 1436 - protein, 9 aa, Artificial Sequence
  source: /note="Description of Artificial Sequence: Synthetic peptide"
LQSRIFPRT

SEQ ID NO: 1437 - protein, 9 aa, Artificial Sequence
  source: /note="Description of Artificial Sequence: Synthetic peptide"
LQSRTIPRT

SEQ ID NO: 1438 - protein, 9 aa, Artificial Sequence
  source: /note="Description of Artificial Sequence: Synthetic peptide"
LQSRTIPRT

SEQ ID NO: 1439 - protein, 7 aa, Artificial Sequence
  source: /note="Description of Artificial Sequence: Synthetic peptide"
GFALSNH

SEQ ID NO: 1440 - protein, 7 aa, Artificial Sequence
  source: /note="Description of Artificial Sequence: Synthetic peptide"
GFTFSNY

SEQ ID NO: 1441 - protein, 7 aa, Artificial Sequence
  source: /note="Description of Artificial Sequence: Synthetic peptide"
GFTFDDY

SEQ ID NO: 1442 - protein, 7 aa, Artificial Sequence
  source: /note="Description of Artificial Sequence: Synthetic peptide"
GFALSNH

SEQ ID NO: 1443 - protein, 7 aa, Artificial Sequence
  source: /note="Description of Artificial Sequence: Synthetic peptide"
GYIFDNF

SEQ ID NO: 1444 - protein, 7 aa, Artificial Sequence
  source: /note="Description of Artificial Sequence: Synthetic peptide"
GFTFSSD

SEQ ID NO: 1445 - protein, 7 aa, Artificial Sequence
  source: /note="Description of Artificial Sequence: Synthetic peptide"
GYTFSNY

SEQ ID NO: 1446 - protein, 7 aa, Artificial Sequence
  source: /note="Description of Artificial Sequence: Synthetic peptide"
GFALSNH

SEQ ID NO: 1447 - protein, 7 aa, Artificial Sequence
  source: /note="Description of Artificial Sequence: Synthetic peptide"
GFALSNH

SEQ ID NO: 1448 - protein, 7 aa, Artificial Sequence
  source: /note="Description of Artificial Sequence: Synthetic peptide"
GFALSNH

SEQ ID NO: 1449 - protein, 7 aa, Artificial Sequence
  source: /note="Description of Artificial Sequence: Synthetic peptide"
GFTFSDY

SEQ ID NO: 1450 - protein, 7 aa, Artificial Sequence
  source: /note="Description of Artificial Sequence: Synthetic peptide"
GFTFSDY

SEQ ID NO: 1451 - protein, 7 aa, Artificial Sequence
  source: /note="Description of Artificial Sequence: Synthetic peptide"
GFALSNH

SEQ ID NO: 1452 - protein, 7 aa, Artificial Sequence
  source: /note="Description of Artificial Sequence: Synthetic peptide"
GFALSNH

SEQ ID NO: 1453 - protein, 7 aa, Artificial Sequence
  source: /note="Description of Artificial Sequence: Synthetic peptide"
GFALSNH

SEQ ID NO: 1454 - protein, 9 aa, Artificial Sequence
  source: /note="Description of Artificial Sequence: Synthetic peptide"
GGSISSSYY

SEQ ID NO: 1455 - protein, 9 aa, Artificial Sequence
  source: /note="Description of Artificial Sequence: Synthetic peptide"
GFSLRTSGM

SEQ ID NO: 1456 - protein, 7 aa, Artificial Sequence
  source: /note="Description of Artificial Sequence: Synthetic peptide"
GFTFSSY

SEQ ID NO: 1457 - protein, 7 aa, Artificial Sequence
  source: /note="Description of Artificial Sequence: Synthetic peptide"
GFTFSDY

SEQ ID NO: 1458 - protein, 7 aa, Artificial Sequence
  source: /note="Description of Artificial Sequence: Synthetic peptide"
GYTVTSH

SEQ ID NO: 1459 - protein, 9 aa, Artificial Sequence
  source: /note="Description of Artificial Sequence: Synthetic peptide"
GGSISSGGY

SEQ ID NO: 1460 - protein, 7 aa, Artificial Sequence
  source: /note="Description of Artificial Sequence: Synthetic peptide"
GGTFSSY

SEQ ID NO: 1461 - protein, 9 aa, Artificial Sequence
  source: /note="Description of Artificial Sequence: Synthetic peptide"
GDSVSSNSA

SEQ ID NO: 1462 - protein, 7 aa, Artificial Sequence
  source: /note="Description of Artificial Sequence: Synthetic peptide"
GFTFSSY

SEQ ID NO: 1463 - protein, 7 aa, Artificial Sequence
  source: /note="Description of Artificial Sequence: Synthetic peptide"
GITFSRY

SEQ ID NO: 1464 - protein, 7 aa, Artificial Sequence
  source: /note="Description of Artificial Sequence: Synthetic peptide"
GFTFSSY

SEQ ID NO: 1465 - protein, 7 aa, Artificial Sequence
  source: /note="Description of Artificial Sequence: Synthetic peptide"
GFTFSSY

SEQ ID NO: 1466 - protein, 7 aa, Artificial Sequence
  source: /note="Description of Artificial Sequence: Synthetic peptide"
GFTFDDY

SEQ ID NO: 1467 - protein, 7 aa, Artificial Sequence
  source: /note="Description of Artificial Sequence: Synthetic peptide"
GFTFDDY

SEQ ID NO: 1468 - protein, 7 aa, Artificial Sequence
  source: /note="Description of Artificial Sequence: Synthetic peptide"
GFTFSSY

SEQ ID NO: 1469 - protein, 7 aa, Artificial Sequence
  source: /note="Description of Artificial Sequence: Synthetic peptide"
GFTFSSY

SEQ ID NO: 1470 - protein, 7 aa, Artificial Sequence
  source: /note="Description of Artificial Sequence: Synthetic peptide"
GFTFSSY

SEQ ID NO: 1471 - protein, 7 aa, Artificial Sequence
  source: /note="Description of Artificial Sequence: Synthetic peptide"
GFSFSSY

SEQ ID NO: 1472 - protein, 7 aa, Artificial Sequence
  source: /note="Description of Artificial Sequence: Synthetic peptide"
GFTFSSY

SEQ ID NO: 1473 - protein, 7 aa, Artificial Sequence
  source: /note="Description of Artificial Sequence: Synthetic peptide"
GFTFSSY

SEQ ID NO: 1474 - protein, 7 aa, Artificial Sequence
  source: /note="Description of Artificial Sequence: Synthetic peptide"
GFTFSSY

SEQ ID NO: 1475 - protein, 7 aa, Artificial Sequence
  source: /note="Description of Artificial Sequence: Synthetic peptide"
GYTFTNF

SEQ ID NO: 1476 - protein, 7 aa, Artificial Sequence
  source: /note="Description of Artificial Sequence: Synthetic peptide"
GYTFTDY

SEQ ID NO: 1477 - protein, 7 aa, Artificial Sequence
  source: /note="Description of Artificial Sequence: Synthetic peptide"
GYTFRHY

SEQ ID NO: 1478 - protein, 7 aa, Artificial Sequence
  source: /note="Description of Artificial Sequence: Synthetic peptide"
GYTFTHY

SEQ ID NO: 1479 - protein, 5 aa, Artificial Sequence
  source: /note="Description of Artificial Sequence: Synthetic peptide"
VYSGS

SEQ ID NO: 1480 - protein, 6 aa, Artificial Sequence
  source: /note="Description of Artificial Sequence: Synthetic peptide"
SRSGEN

SEQ ID NO: 1481 - protein, 6 aa, Artificial Sequence
  source: /note="Description of Artificial Sequence: Synthetic peptide"
SWNSGS

SEQ ID NO: 1482 - protein, 5 aa, Artificial Sequence
  source: /note="Description of Artificial Sequence: Synthetic peptide"
VYSGS

SEQ ID NO: 1483 - protein, 6 aa, Artificial Sequence
  source: /note="Description of Artificial Sequence: Synthetic peptide"
NPKNNN

SEQ ID NO: 1484 - protein, 6 aa, Artificial Sequence
  source: /note="Description of Artificial Sequence: Synthetic peptide"
SGSGGT

SEQ ID NO: 1485 - protein, 6 aa, Artificial Sequence
  source: /note="Description of Artificial Sequence: Synthetic peptide"
SAYNGN

SEQ ID NO: 1486 - protein, 5 aa, Artificial Sequence
  source: /note="Description of Artificial Sequence: Synthetic peptide"
VYSGS

SEQ ID NO: 1487 - protein, 5 aa, Artificial Sequence
  source: /note="Description of Artificial Sequence: Synthetic peptide"
VYSGS

SEQ ID NO: 1488 - protein, 5 aa, Artificial Sequence
  source: /note="Description of Artificial Sequence: Synthetic peptide"
VYSGS

SEQ ID NO: 1489 - protein, 6 aa, Artificial Sequence
  source: /note="Description of Artificial Sequence: Synthetic peptide"
SSSGST

SEQ ID NO: 1490 - protein, 6 aa, Artificial Sequence
  source: /note="Description of Artificial Sequence: Synthetic peptide"
SSSGNT

SEQ ID NO: 1491 - protein, 5 aa, Artificial Sequence
  source: /note="Description of Artificial Sequence: Synthetic peptide"
VYSGS

SEQ ID NO: 1492 - protein, 5 aa, Artificial Sequence
  source: /note="Description of Artificial Sequence: Synthetic peptide"
VYSGS

SEQ ID NO: 1493 - protein, 5 aa, Artificial Sequence
  source: /note="Description of Artificial Sequence: Synthetic peptide"
VYSGS

SEQ ID NO: 1494 - protein, 5 aa, Artificial Sequence
  source: /note="Description of Artificial Sequence: Synthetic peptide"
YYSGS

SEQ ID NO: 1495 - protein, 5 aa, Artificial Sequence
  source: /note="Description of Artificial Sequence: Synthetic peptide"
DWDED

SEQ ID NO: 1496 - protein, 6 aa, Artificial Sequence
  source: /note="Description of Artificial Sequence: Synthetic peptide"
SSSSSY

SEQ ID NO: 1497 - protein, 6 aa, Artificial Sequence
  source: /note="Description of Artificial Sequence: Synthetic peptide"
SSSGST

SEQ ID NO: 1498 - protein, 6 aa, Artificial Sequence
  source: /note="Description of Artificial Sequence: Synthetic peptide"
NPSGGV

SEQ ID NO: 1499 - protein, 5 aa, Artificial Sequence
  source: /note="Description of Artificial Sequence: Synthetic peptide"
YYSGS

SEQ ID NO: 1500 - protein, 6 aa, Artificial Sequence
  source: /note="Description of Artificial Sequence: Synthetic peptide"
IPIFGT

SEQ ID NO: 1501 - protein, 7 aa, Artificial Sequence
  source: /note="Description of Artificial Sequence: Synthetic peptide"
YYRSKWY

SEQ ID NO: 1502 - protein, 6 aa, Artificial Sequence
  source: /note="Description of Artificial Sequence: Synthetic peptide"
SGSGGS

SEQ ID NO: 1503 - protein, 6 aa, Artificial Sequence
  source: /note="Description of Artificial Sequence: Synthetic peptide"
SDSGVS

SEQ ID NO: 1504 - protein, 6 aa, Artificial Sequence
  source: /note="Description of Artificial Sequence: Synthetic peptide"
SGSGGS

SEQ ID NO: 1505 - protein, 6 aa, Artificial Sequence
  source: /note="Description of Artificial Sequence: Synthetic peptide"
SGSGGS

SEQ ID NO: 1506 - protein, 6 aa, Artificial Sequence
  source: /note="Description of Artificial Sequence: Synthetic peptide"
SWNSGS

SEQ ID NO: 1507 - protein, 6 aa, Artificial Sequence
  source: /note="Description of Artificial Sequence: Synthetic peptide"
NWKGNS

SEQ ID NO: 1508 - protein, 6 aa, Artificial Sequence
  source: /note="Description of Artificial Sequence: Synthetic peptide"
SGSGGS

SEQ ID NO: 1509 - protein, 6 aa, Artificial Sequence
  source: /note="Description of Artificial Sequence: Synthetic peptide"
SGSGGS

SEQ ID NO: 1510 - protein, 6 aa, Artificial Sequence
  source: /note="Description of Artificial Sequence: Synthetic peptide"
SGSGGS

SEQ ID NO: 1511 - protein, 6 aa, Artificial Sequence
  source: /note="Description of Artificial Sequence: Synthetic peptide"
SGSGGS

SEQ ID NO: 1512 - protein, 6 aa, Artificial Sequence
  source: /note="Description of Artificial Sequence: Synthetic peptide"
SGSGGS

SEQ ID NO: 1513 - protein, 6 aa, Artificial Sequence
  source: /note="Description of Artificial Sequence: Synthetic peptide"
SGSGGS

SEQ ID NO: 1514 - protein, 6 aa, Artificial Sequence
  source: /note="Description of Artificial Sequence: Synthetic peptide"
SGSGGS

SEQ ID NO: 1515 - protein, 6 aa, Artificial Sequence
  source: /note="Description of Artificial Sequence: Synthetic peptide"
NTYTGE

SEQ ID NO: 1516 - protein, 6 aa, Artificial Sequence
  source: /note="Description of Artificial Sequence: Synthetic peptide"
NTETRE

SEQ ID NO: 1517 - protein, 6 aa, Artificial Sequence
  source: /note="Description of Artificial Sequence: Synthetic peptide"
NTESGV

SEQ ID NO: 1518 - protein, 6 aa, Artificial Sequence
  source: /note="Description of Artificial Sequence: Synthetic peptide"
NTETGE

SEQ ID NO: 1519 - protein, 7 aa, Artificial Sequence
  source: /note="Description of Artificial Sequence: Synthetic peptide"
HGGESDV

SEQ ID NO: 1520 - protein, 11 aa, Artificial Sequence
  source: /note="Description of Artificial Sequence: Synthetic peptide"
SPAHYYGGMDV

SEQ ID NO: 1521 - protein, 6 aa, Artificial Sequence
  source: /note="Description of Artificial Sequence: Synthetic peptide"
HSFLAY

SEQ ID NO: 1522 - protein, 7 aa, Artificial Sequence
  source: /note="Description of Artificial Sequence: Synthetic peptide"
HGGESDV

SEQ ID NO: 1523 - protein, 11 aa, Artificial Sequence
  source: /note="Description of Artificial Sequence: Synthetic peptide"
GPYYYQSYMDV

SEQ ID NO: 1524 - protein, 14 aa, Artificial Sequence
  source: /note="Description of Artificial Sequence: Synthetic peptide"
LDSSGYYYARGPRY

SEQ ID NO: 1525 - protein, 9 aa, Artificial Sequence
  source: /note="Description of Artificial Sequence: Synthetic peptide"
GPYYYYMDV

SEQ ID NO: 1526 - protein, 7 aa, Artificial Sequence
  source: /note="Description of Artificial Sequence: Synthetic peptide"
HGGESDV

SEQ ID NO: 1527 - protein, 7 aa, Artificial Sequence
  source: /note="Description of Artificial Sequence: Synthetic peptide"
HGGESDV

SEQ ID NO: 1528 - protein, 7 aa, Artificial Sequence
  source: /note="Description of Artificial Sequence: Synthetic peptide"
HGGESDV

SEQ ID NO: 1529 - protein, 8 aa, Artificial Sequence
  source: /note="Description of Artificial Sequence: Synthetic peptide"
ESGDGMDV

SEQ ID NO: 1530 - protein, 8 aa, Artificial Sequence
  source: /note="Description of Artificial Sequence: Synthetic peptide"
STMVREDY

SEQ ID NO: 1531 - protein, 7 aa, Artificial Sequence
  source: /note="Description of Artificial Sequence: Synthetic peptide"
HGGESDV

SEQ ID NO: 1532 - protein, 7 aa, Artificial Sequence
  source: /note="Description of Artificial Sequence: Synthetic peptide"
HGGESDV

SEQ ID NO: 1533 - protein, 7 aa, Artificial Sequence
  source: /note="Description of Artificial Sequence: Synthetic peptide"
HGGESDV

SEQ ID NO: 1534 - protein, 11 aa, Artificial Sequence
  source: /note="Description of Artificial Sequence: Synthetic peptide"
HWQEWPDAFDI

SEQ ID NO: 1535 - protein, 13 aa, Artificial Sequence
  source: /note="Description of Artificial Sequence: Synthetic peptide"
SGAGGTSATAFDI

SEQ ID NO: 1536 - protein, 10 aa, Artificial Sequence
  source: /note="Description of Artificial Sequence: Synthetic peptide"
TIAAVYAFDI

SEQ ID NO: 1537 - protein, 8 aa, Artificial Sequence
  source: /note="Description of Artificial Sequence: Synthetic peptide"
DLRGAFDI

SEQ ID NO: 1538 - protein, 11 aa, Artificial Sequence
  source: /note="Description of Artificial Sequence: Synthetic peptide"
EGSGSGWYFDF

SEQ ID NO: 1539 - protein, 13 aa, Artificial Sequence
  source: /note="Description of Artificial Sequence: Synthetic peptide"
AGIAARLRGAFDI

SEQ ID NO: 1540 - protein, 20 aa, Artificial Sequence
  source: /note="Description of Artificial Sequence: Synthetic peptide"
RGGYQLLRWDVGLLRSAFDI

SEQ ID NO: 1541 - protein, 13 aa, Artificial Sequence
  source: /note="Description of Artificial Sequence: Synthetic peptide"
SSPEGLFLYWFDP

SEQ ID NO: 1542 - protein, 9 aa, Artificial Sequence
  source: /note="Description of Artificial Sequence: Synthetic peptide"
VEGSGSLDY

SEQ ID NO: 1543 - protein, 9 aa, Artificial Sequence
  source: /note="Description of Artificial Sequence: Synthetic peptide"
RAGSEASDI

SEQ ID NO: 1544 - protein, 15 aa, Artificial Sequence
  source: /note="Description of Artificial Sequence: Synthetic peptide"
ATYKRELRYYYGMDV

SEQ ID NO: 1545 - protein, 15 aa, Artificial Sequence
  source: /note="Description of Artificial Sequence: Synthetic peptide"
ATYKRELRYYYGMDV

SEQ ID NO: 1546 - protein, 8 aa, Artificial Sequence
  source: /note="Description of Artificial Sequence: Synthetic peptide"
VGKAVPDV

SEQ ID NO: 1547 - protein, 13 aa, Artificial Sequence
  source: /note="Description of Artificial Sequence: Synthetic peptide"
HQGVAYYNYAMDV

SEQ ID NO: 1548 - protein, 8 aa, Artificial Sequence
  source: /note="Description of Artificial Sequence: Synthetic peptide"
VVRDGMDV

SEQ ID NO: 1549 - protein, 9 aa, Artificial Sequence
  source: /note="Description of Artificial Sequence: Synthetic peptide"
IPQTGTFDY

SEQ ID NO: 1550 - protein, 15 aa, Artificial Sequence
  source: /note="Description of Artificial Sequence: Synthetic peptide"
ANYKRELRYYYGMDV

SEQ ID NO: 1551 - protein, 11 aa, Artificial Sequence
  source: /note="Description of Artificial Sequence: Synthetic peptide"
ALVGATGAFDI

SEQ ID NO: 1552 - protein, 8 aa, Artificial Sequence
  source: /note="Description of Artificial Sequence: Synthetic peptide"
WFGEGFDP

SEQ ID NO: 1553 - protein, 17 aa, Artificial Sequence
  source: /note="Description of Artificial Sequence: Synthetic peptide"
VGYDSSGYYRDYYGMDV

SEQ ID NO: 1554 - protein, 13 aa, Artificial Sequence
  source: /note="Description of Artificial Sequence: Synthetic peptide"
MGWSSGYLGAFDI

SEQ ID NO: 1555 - protein, 13 aa, Artificial Sequence
  source: /note="Description of Artificial Sequence: Synthetic peptide"
GEIYYGYDGGFAY

SEQ ID NO: 1556 - protein, 8 aa, Artificial Sequence
  source: /note="Description of Artificial Sequence: Synthetic peptide"
DYSYAMDY

SEQ ID NO: 1557 - protein, 8 aa, Artificial Sequence
  source: /note="Description of Artificial Sequence: Synthetic peptide"
DYLYSLDF

SEQ ID NO: 1558 - protein, 8 aa, Artificial Sequence
  source: /note="Description of Artificial Sequence: Synthetic peptide"
DYLYSCDY

SEQ ID NO: 1559 - protein, 7 aa, Artificial Sequence
  source: /note="Description of Artificial Sequence: Synthetic peptide"
SQSISSY

SEQ ID NO: 1560 - protein, 8 aa, Artificial Sequence
  source: /note="Description of Artificial Sequence: Synthetic peptide"
SQSISSSF

SEQ ID NO: 1561 - protein, 12 aa, Artificial Sequence
  source: /note="Description of Artificial Sequence: Synthetic peptide"
SQSLLHSNGYNY

SEQ ID NO: 1562 - protein, 12 aa, Artificial Sequence
  source: /note="Description of Artificial Sequence: Synthetic peptide"
SQSLLRNDGKTP

SEQ ID NO: 1563 - protein, 12 aa, Artificial Sequence
  source: /note="Description of Artificial Sequence: Synthetic peptide"
SQSLLHSNGYNY

SEQ ID NO: 1564 - protein, 7 aa, Artificial Sequence
  source: /note="Description of Artificial Sequence: Synthetic peptide"
SQSISSY

SEQ ID NO: 1565 - protein, 12 aa, Artificial Sequence
  source: /note="Description of Artificial Sequence: Synthetic peptide"
SQSLLYSNGYNY

SEQ ID NO: 1566 - protein, 7 aa, Artificial Sequence
  source: /note="Description of Artificial Sequence: Synthetic peptide"
SQSVSSN

SEQ ID NO: 1567 - protein, 7 aa, Artificial Sequence
  source: /note="Description of Artificial Sequence: Synthetic peptide"
SQSVSSK

SEQ ID NO: 1568 - protein, 8 aa, Artificial Sequence
  source: /note="Description of Artificial Sequence: Synthetic peptide"
SQSVGSTN

SEQ ID NO: 1569 - protein, 7 aa, Artificial Sequence
  source: /note="Description of Artificial Sequence: Synthetic peptide"
SQSISSY

SEQ ID NO: 1570 - protein, 12 aa, Artificial Sequence
  source: /note="Description of Artificial Sequence: Synthetic peptide"
SESLVHNSGKTY

SEQ ID NO: 1571 - protein, 7 aa, Artificial Sequence
  source: /note="Description of Artificial Sequence: Synthetic peptide"
SEDINKF

SEQ ID NO: 1572 - protein, 7 aa, Artificial Sequence
  source: /note="Description of Artificial Sequence: Synthetic peptide"
SQSVGSN

SEQ ID NO: 1573 - protein, 8 aa, Artificial Sequence
  source: /note="Description of Artificial Sequence: Synthetic peptide"
SQSIGSSS

SEQ ID NO: 1574 - protein, 7 aa, Artificial Sequence
  source: /note="Description of Artificial Sequence: Synthetic peptide"
SQDIDDA

SEQ ID NO: 1575 - protein, 7 aa, Artificial Sequence
  source: /note="Description of Artificial Sequence: Synthetic peptide"
SQDIYNN

SEQ ID NO: 1576 - protein, 12 aa, Artificial Sequence
  source: /note="Description of Artificial Sequence: Synthetic peptide"
SQSLLHSNGYNY

SEQ ID NO: 1577 - protein, 7 aa, Artificial Sequence
  source: /note="Description of Artificial Sequence: Synthetic peptide"
NNIGTKS

SEQ ID NO: 1578 - protein, 7 aa, Artificial Sequence
  source: /note="Description of Artificial Sequence: Synthetic peptide"
DGLSKKY

SEQ ID NO: 1579 - protein, 7 aa, Artificial Sequence
  source: /note="Description of Artificial Sequence: Synthetic peptide"
SQGIRNW

SEQ ID NO: 1580 - protein, 7 aa, Artificial Sequence
  source: /note="Description of Artificial Sequence: Synthetic peptide"
NNIGSKS

SEQ ID NO: 1581 - protein, 7 aa, Artificial Sequence
  source: /note="Description of Artificial Sequence: Synthetic peptide"
DSLGNYY

SEQ ID NO: 1582 - protein, 8 aa, Artificial Sequence
  source: /note="Description of Artificial Sequence: Synthetic peptide"
SQSVSSAY

SEQ ID NO: 1583 - protein, 7 aa, Artificial Sequence
  source: /note="Description of Artificial Sequence: Synthetic peptide"
SQSVSNS

SEQ ID NO: 1584 - protein, 8 aa, Artificial Sequence
  source: /note="Description of Artificial Sequence: Synthetic peptide"
SQSVSSSF

SEQ ID NO: 1585 - protein, 8 aa, Artificial Sequence
  source: /note="Description of Artificial Sequence: Synthetic peptide"
SQSVSTTF

SEQ ID NO: 1586 - protein, 7 aa, Artificial Sequence
  source: /note="Description of Artificial Sequence: Synthetic peptide"
SQSISSY

SEQ ID NO: 1587 - protein, 8 aa, Artificial Sequence
  source: /note="Description of Artificial Sequence: Synthetic peptide"
TQSIGSSF

SEQ ID NO: 1588 - protein, 8 aa, Artificial Sequence
  source: /note="Description of Artificial Sequence: Synthetic peptide"
SQSVSSSY

SEQ ID NO: 1589 - protein, 8 aa, Artificial Sequence
  source: /note="Description of Artificial Sequence: Synthetic peptide"
SQSVSSSY

SEQ ID NO: 1590 - protein, 8 aa, Artificial Sequence
  source: /note="Description of Artificial Sequence: Synthetic peptide"
SQRVASNY

SEQ ID NO: 1591 - protein, 8 aa, Artificial Sequence
  source: /note="Description of Artificial Sequence: Synthetic peptide"
SQSLSSNF

SEQ ID NO: 1592 - protein, 12 aa, Artificial Sequence
  source: /note="Description of Artificial Sequence: Synthetic peptide"
SQSLLHSNGYNY

SEQ ID NO: 1593 - protein, 8 aa, Artificial Sequence
  source: /note="Description of Artificial Sequence: Synthetic peptide"
SQSVSSSY

SEQ ID NO: 1594 - protein, 8 aa, Artificial Sequence
  source: /note="Description of Artificial Sequence: Synthetic peptide"
SQSVASSF

SEQ ID NO: 1595 - protein, 7 aa, Artificial Sequence
  source: /note="Description of Artificial Sequence: Synthetic peptide"
SQDVNTA

SEQ ID NO: 1596 - protein, 11 aa, Artificial Sequence
  source: /note="Description of Artificial Sequence: Synthetic peptide"
SESVSVIGAHL

SEQ ID NO: 1597 - protein, 11 aa, Artificial Sequence
  source: /note="Description of Artificial Sequence: Synthetic peptide"
SESVTILGSHL

SEQ ID NO: 1598 - protein, 11 aa, Artificial Sequence
  source: /note="Description of Artificial Sequence: Synthetic peptide"
SESVTILGSHL

SEQ ID NO: 1599 - protein, 3 aa, Artificial Sequence
  source: /note="Description of Artificial Sequence: Synthetic peptide"
AAS

SEQ ID NO: 1600 - protein, 3 aa, Artificial Sequence
  source: /note="Description of Artificial Sequence: Synthetic peptide"
GAS

SEQ ID NO: 1601 - protein, 3 aa, Artificial Sequence
  source: /note="Description of Artificial Sequence: Synthetic peptide"
LGS

SEQ ID NO: 1602 - protein, 3 aa, Artificial Sequence
  source: /note="Description of Artificial Sequence: Synthetic peptide"
EVS

SEQ ID NO: 1603 - protein, 3 aa, Artificial Sequence
  source: /note="Description of Artificial Sequence: Synthetic peptide"
LGS

SEQ ID NO: 1604 - protein, 3 aa, Artificial Sequence
  source: /note="Description of Artificial Sequence: Synthetic peptide"
GAS

SEQ ID NO: 1605 - protein, 3 aa, Artificial Sequence
  source: /note="Description of Artificial Sequence: Synthetic peptide"
LGS

SEQ ID NO: 1606 - protein, 3 aa, Artificial Sequence
  source: /note="Description of Artificial Sequence: Synthetic peptide"
GAS

SEQ ID NO: 1607 - protein, 3 aa, Artificial Sequence
  source: /note="Description of Artificial Sequence: Synthetic peptide"
GAS

SEQ ID NO: 1608 - protein, 3 aa, Artificial Sequence
  source: /note="Description of Artificial Sequence: Synthetic peptide"
DAS

SEQ ID NO: 1609 - protein, 3 aa, Artificial Sequence
  source: /note="Description of Artificial Sequence: Synthetic peptide"
AAS

SEQ ID NO: 1610 - protein, 3 aa, Artificial Sequence
  source: /note="Description of Artificial Sequence: Synthetic peptide"
EVS

SEQ ID NO: 1611 - protein, 3 aa, Artificial Sequence
  source: /note="Description of Artificial Sequence: Synthetic peptide"
DAS

SEQ ID NO: 1612 - protein, 3 aa, Artificial Sequence
  source: /note="Description of Artificial Sequence: Synthetic peptide"
GAS

SEQ ID NO: 1613 - protein, 3 aa, Artificial Sequence
  source: /note="Description of Artificial Sequence: Synthetic peptide"
GAS

SEQ ID NO: 1614 - protein, 3 aa, Artificial Sequence
  source: /note="Description of Artificial Sequence: Synthetic peptide"
SAT

SEQ ID NO: 1615 - protein, 3 aa, Artificial Sequence
  source: /note="Description of Artificial Sequence: Synthetic peptide"
AAN

SEQ ID NO: 1616 - protein, 3 aa, Artificial Sequence
  source: /note="Description of Artificial Sequence: Synthetic peptide"
LGS

SEQ ID NO: 1617 - protein, 3 aa, Artificial Sequence
  source: /note="Description of Artificial Sequence: Synthetic peptide"
DDS

SEQ ID NO: 1618 - protein, 3 aa, Artificial Sequence
  source: /note="Description of Artificial Sequence: Synthetic peptide"
RDK

SEQ ID NO: 1619 - protein, 3 aa, Artificial Sequence
  source: /note="Description of Artificial Sequence: Synthetic peptide"
AAS

SEQ ID NO: 1620 - protein, 3 aa, Artificial Sequence
  source: /note="Description of Artificial Sequence: Synthetic peptide"
GKN

SEQ ID NO: 1621 - protein, 3 aa, Artificial Sequence
  source: /note="Description of Artificial Sequence: Synthetic peptide"
GTN

SEQ ID NO: 1622 - protein, 3 aa, Artificial Sequence
  source: /note="Description of Artificial Sequence: Synthetic peptide"
GAS

SEQ ID NO: 1623 - protein, 3 aa, Artificial Sequence
  source: /note="Description of Artificial Sequence: Synthetic peptide"
DAS

SEQ ID NO: 1624 - protein, 3 aa, Artificial Sequence
  source: /note="Description of Artificial Sequence: Synthetic peptide"
GAS

SEQ ID NO: 1625 - protein, 3 aa, Artificial Sequence
  source: /note="Description of Artificial Sequence: Synthetic peptide"
GSS

SEQ ID NO: 1626 - protein, 3 aa, Artificial Sequence
  source: /note="Description of Artificial Sequence: Synthetic peptide"
AAS

SEQ ID NO: 1627 - protein, 3 aa, Artificial Sequence
  source: /note="Description of Artificial Sequence: Synthetic peptide"
GAS

SEQ ID NO: 1628 - protein, 3 aa, Artificial Sequence
  source: /note="Description of Artificial Sequence: Synthetic peptide"
GAS

SEQ ID NO: 1629 - protein, 3 aa, Artificial Sequence
  source: /note="Description of Artificial Sequence: Synthetic peptide"
GAS

SEQ ID NO: 1630 - protein, 3 aa, Artificial Sequence
  source: /note="Description of Artificial Sequence: Synthetic peptide"
GAS

SEQ ID NO: 1631 - protein, 3 aa, Artificial Sequence
  source: /note="Description of Artificial Sequence: Synthetic peptide"
GAS

SEQ ID NO: 1632 - protein, 3 aa, Artificial Sequence
  source: /note="Description of Artificial Sequence: Synthetic peptide"
LGS

SEQ ID NO: 1633 - protein, 3 aa, Artificial Sequence
  source: /note="Description of Artificial Sequence: Synthetic peptide"
GTS

SEQ ID NO: 1634 - protein, 3 aa, Artificial Sequence
  source: /note="Description of Artificial Sequence: Synthetic peptide"
GAS

SEQ ID NO: 1635 - protein, 3 aa, Artificial Sequence
  source: /note="Description of Artificial Sequence: Synthetic peptide"
SAS

SEQ ID NO: 1636 - protein, 3 aa, Artificial Sequence
  source: /note="Description of Artificial Sequence: Synthetic peptide"
LAS

SEQ ID NO: 1637 - protein, 3 aa, Artificial Sequence
  source: /note="Description of Artificial Sequence: Synthetic peptide"
LAS

SEQ ID NO: 1638 - protein, 3 aa, Artificial Sequence
  source: /note="Description of Artificial Sequence: Synthetic peptide"
LAS

SEQ ID NO: 1639 - protein, 6 aa, Artificial Sequence
  source: /note="Description of Artificial Sequence: Synthetic peptide"
SYSTPY

SEQ ID NO: 1640 - protein, 7 aa, Artificial Sequence
  source: /note="Description of Artificial Sequence: Synthetic peptide"
YHSSPSW

SEQ ID NO: 1641 - protein, 6 aa, Artificial Sequence
  source: /note="Description of Artificial Sequence: Synthetic peptide"
ALQTPY

SEQ ID NO: 1642 - protein, 5 aa, Artificial Sequence
  source: /note="Description of Artificial Sequence: Synthetic peptide"
NIQFP

SEQ ID NO: 1643 - protein, 6 aa, Artificial Sequence
  source: /note="Description of Artificial Sequence: Synthetic peptide"
ALQTPY

SEQ ID NO: 1644 - protein, 5 aa, Artificial Sequence
  source: /note="Description of Artificial Sequence: Synthetic peptide"
SYKRA

SEQ ID NO: 1645 - protein, 6 aa, Artificial Sequence
  source: /note="Description of Artificial Sequence: Synthetic peptide"
GRQFPY

SEQ ID NO: 1646 - protein, 5 aa, Artificial Sequence
  source: /note="Description of Artificial Sequence: Synthetic peptide"
YGSSL

SEQ ID NO: 1647 - protein, 6 aa, Artificial Sequence
  source: /note="Description of Artificial Sequence: Synthetic peptide"
YGSSSW

SEQ ID NO: 1648 - protein, 7 aa, Artificial Sequence
  source: /note="Description of Artificial Sequence: Synthetic peptide"
YGSSPPW

SEQ ID NO: 1649 - protein, 4 aa, Artificial Sequence
  source: /note="Description of Artificial Sequence: Synthetic peptide"
SYTL

SEQ ID NO: 1650 - protein, 6 aa, Artificial Sequence
  source: /note="Description of Artificial Sequence: Synthetic peptide"
GTHWPG

SEQ ID NO: 1651 - protein, 6 aa, Artificial Sequence
  source: /note="Description of Artificial Sequence: Synthetic peptide"
YESLPL

SEQ ID NO: 1652 - protein, 7 aa, Artificial Sequence
  source: /note="Description of Artificial Sequence: Synthetic peptide"
YNDWLPV

SEQ ID NO: 1653 - protein, 7 aa, Artificial Sequence
  source: /note="Description of Artificial Sequence: Synthetic peptide"
YAGSPPF

SEQ ID NO: 1654 - protein, 6 aa, Artificial Sequence
  source: /note="Description of Artificial Sequence: Synthetic peptide"
HDNFPL

SEQ ID NO: 1655 - protein, 6 aa, Artificial Sequence
  source: /note="Description of Artificial Sequence: Synthetic peptide"
YYRFPY

SEQ ID NO: 1656 - protein, 6 aa, Artificial Sequence
  source: /note="Description of Artificial Sequence: Synthetic peptide"
ALQTPY

SEQ ID NO: 1657 - protein, 8 aa, Artificial Sequence
  source: /note="Description of Artificial Sequence: Synthetic peptide"
WDSDSEHV

SEQ ID NO: 1658 - protein, 6 aa, Artificial Sequence
  source: /note="Description of Artificial Sequence: Synthetic peptide"
WDDTTV

SEQ ID NO: 1659 - protein, 6 aa, Artificial Sequence
  source: /note="Description of Artificial Sequence: Synthetic peptide"
YNSAPF

SEQ ID NO: 1660 - protein, 9 aa, Artificial Sequence
  source: /note="Description of Artificial Sequence: Synthetic peptide"
RDSSGDHLR

SEQ ID NO: 1661 - protein, 8 aa, Artificial Sequence
  source: /note="Description of Artificial Sequence: Synthetic peptide"
RDSSGHHL

SEQ ID NO: 1662 - protein, 11 aa, Artificial Sequence
  source: /note="Description of Artificial Sequence: Synthetic peptide"
YGSSFNGSSLF

SEQ ID NO: 1663 - protein, 7 aa, Artificial Sequence
  source: /note="Description of Artificial Sequence: Synthetic peptide"
FGTSSGL

SEQ ID NO: 1664 - protein, 7 aa, Artificial Sequence
  source: /note="Description of Artificial Sequence: Synthetic peptide"
YHSSPSW

SEQ ID NO: 1665 - protein, 7 aa, Artificial Sequence
  source: /note="Description of Artificial Sequence: Synthetic peptide"
YHSSPSW

SEQ ID NO: 1666 - protein, 6 aa, Artificial Sequence
  source: /note="Description of Artificial Sequence: Synthetic peptide"
SYSTPY

SEQ ID NO: 1667 - protein, 7 aa, Artificial Sequence
  source: /note="Description of Artificial Sequence: Synthetic peptide"
YESSPSW

SEQ ID NO: 1668 - protein, 7 aa, Artificial Sequence
  source: /note="Description of Artificial Sequence: Synthetic peptide"
YGSPPRF

SEQ ID NO: 1669 - protein, 7 aa, Artificial Sequence
  source: /note="Description of Artificial Sequence: Synthetic peptide"
YGSSPSW

SEQ ID NO: 1670 - protein, 7 aa, Artificial Sequence
  source: /note="Description of Artificial Sequence: Synthetic peptide"
YDSSPSW

SEQ ID NO: 1671 - protein, 7 aa, Artificial Sequence
  source: /note="Description of Artificial Sequence: Synthetic peptide"
YGTSPMY

SEQ ID NO: 1672 - protein, 6 aa, Artificial Sequence
  source: /note="Description of Artificial Sequence: Synthetic peptide"
ALQTPL

SEQ ID NO: 1673 - protein, 8 aa, Artificial Sequence
  source: /note="Description of Artificial Sequence: Synthetic peptide"
YGNSPPKF

SEQ ID NO: 1674 - protein, 7 aa, Artificial Sequence
  source: /note="Description of Artificial Sequence: Synthetic peptide"
YGGSPRL

SEQ ID NO: 1675 - protein, 6 aa, Artificial Sequence
  source: /note="Description of Artificial Sequence: Synthetic peptide"
HYSTPW

SEQ ID NO: 1676 - protein, 6 aa, Artificial Sequence
  source: /note="Description of Artificial Sequence: Synthetic peptide"
SRIFPR

SEQ ID NO: 1677 - protein, 6 aa, Artificial Sequence
  source: /note="Description of Artificial Sequence: Synthetic peptide"
SRTIPR

SEQ ID NO: 1678 - protein, 6 aa, Artificial Sequence
  source: /note="Description of Artificial Sequence: Synthetic peptide"
SRTIPR

SEQ ID NO: 1679 - protein, 10 aa, Artificial Sequence
  source: /note="Description of Artificial Sequence: Synthetic peptide"
GFALSNHGMS

SEQ ID NO: 1680 - protein, 10 aa, Artificial Sequence
  source: /note="Description of Artificial Sequence: Synthetic peptide"
GFTFSNYAMS

SEQ ID NO: 1681 - protein, 10 aa, Artificial Sequence
  source: /note="Description of Artificial Sequence: Synthetic peptide"
GFTFDDYAMH

SEQ ID NO: 1682 - protein, 10 aa, Artificial Sequence
  source: /note="Description of Artificial Sequence: Synthetic peptide"
GFALSNHGMS

SEQ ID NO: 1683 - protein, 10 aa, Artificial Sequence
  source: /note="Description of Artificial Sequence: Synthetic peptide"
GYIFDNFGIN

SEQ ID NO: 1684 - protein, 10 aa, Artificial Sequence
  source: /note="Description of Artificial Sequence: Synthetic peptide"
GFTFSSDAMT

SEQ ID NO: 1685 - protein, 10 aa, Artificial Sequence
  source: /note="Description of Artificial Sequence: Synthetic peptide"
GYTFSNYGIT

SEQ ID NO: 1686 - protein, 10 aa, Artificial Sequence
  source: /note="Description of Artificial Sequence: Synthetic peptide"
GFALSNHGMS

SEQ ID NO: 1687 - protein, 10 aa, Artificial Sequence
  source: /note="Description of Artificial Sequence: Synthetic peptide"
GFALSNHGMS

SEQ ID NO: 1688 - protein, 10 aa, Artificial Sequence
  source: /note="Description of Artificial Sequence: Synthetic peptide"
GFALSNHGMS

SEQ ID NO: 1689 - protein, 10 aa, Artificial Sequence
  source: /note="Description of Artificial Sequence: Synthetic peptide"
GFTFSDYYMS

SEQ ID NO: 1690 - protein, 10 aa, Artificial Sequence
  source: /note="Description of Artificial Sequence: Synthetic peptide"
GFTFSDYYMS

SEQ ID NO: 1691 - protein, 10 aa, Artificial Sequence
  source: /note="Description of Artificial Sequence: Synthetic peptide"
GFALSNHGMS

SEQ ID NO: 1692 - protein, 10 aa, Artificial Sequence
  source: /note="Description of Artificial Sequence: Synthetic peptide"
GFALSNHGMS

SEQ ID NO: 1693 - protein, 10 aa, Artificial Sequence
  source: /note="Description of Artificial Sequence: Synthetic peptide"
GFALSNHGMS

SEQ ID NO: 1694 - protein, 12 aa, Artificial Sequence
  source: /note="Description of Artificial Sequence: Synthetic peptide"
GGSISSSYYYWG

SEQ ID NO: 1695 - protein, 12 aa, Artificial Sequence
  source: /note="Description of Artificial Sequence: Synthetic peptide"
GFSLRTSGMCVS

SEQ ID NO: 1696 - protein, 10 aa, Artificial Sequence
  source: /note="Description of Artificial Sequence: Synthetic peptide"
GFTFSSYSMN

SEQ ID NO: 1697 - protein, 10 aa, Artificial Sequence
  source: /note="Description of Artificial Sequence: Synthetic peptide"
GFTFSDYYMS

SEQ ID NO: 1698 - protein, 10 aa, Artificial Sequence
  source: /note="Description of Artificial Sequence: Synthetic peptide"
GYTVTSHYIH

SEQ ID NO: 1699 - protein, 12 aa, Artificial Sequence
  source: /note="Description of Artificial Sequence: Synthetic peptide"
GGSISSGGYYWS

SEQ ID NO: 1700 - protein, 10 aa, Artificial Sequence
  source: /note="Description of Artificial Sequence: Synthetic peptide"
GGTFSSYAIS

SEQ ID NO: 1701 - protein, 12 aa, Artificial Sequence
  source: /note="Description of Artificial Sequence: Synthetic peptide"
GDSVSSNSAAWN

SEQ ID NO: 1702 - protein, 10 aa, Artificial Sequence
  source: /note="Description of Artificial Sequence: Synthetic peptide"
GFTFSSYAMS

SEQ ID NO: 1703 - protein, 10 aa, Artificial Sequence
  source: /note="Description of Artificial Sequence: Synthetic peptide"
GITFSRYPMS

SEQ ID NO: 1704 - protein, 10 aa, Artificial Sequence
  source: /note="Description of Artificial Sequence: Synthetic peptide"
GFTFSSYAMS

SEQ ID NO: 1705 - protein, 10 aa, Artificial Sequence
  source: /note="Description of Artificial Sequence: Synthetic peptide"
GFTFSSYAMS

SEQ ID NO: 1706 - protein, 10 aa, Artificial Sequence
  source: /note="Description of Artificial Sequence: Synthetic peptide"
GFTFDDYAMH

SEQ ID NO: 1707 - protein, 10 aa, Artificial Sequence
  source: /note="Description of Artificial Sequence: Synthetic peptide"
GFTFDDYAMH

SEQ ID NO: 1708 - protein, 10 aa, Artificial Sequence
  source: /note="Description of Artificial Sequence: Synthetic peptide"
GFTFSSYAMS

SEQ ID NO: 1709 - protein, 10 aa, Artificial Sequence
  source: /note="Description of Artificial Sequence: Synthetic peptide"
GFTFSSYAMS

SEQ ID NO: 1710 - protein, 10 aa, Artificial Sequence
  source: /note="Description of Artificial Sequence: Synthetic peptide"
GFTFSSYAMS

SEQ ID NO: 1711 - protein, 10 aa, Artificial Sequence
  source: /note="Description of Artificial Sequence: Synthetic peptide"
GFSFSSYAMS

SEQ ID NO: 1712 - protein, 10 aa, Artificial Sequence
  source: /note="Description of Artificial Sequence: Synthetic peptide"
GFTFSSYAMS

SEQ ID NO: 1713 - protein, 10 aa, Artificial Sequence
  source: /note="Description of Artificial Sequence: Synthetic peptide"
GFTFSSYAMS

SEQ ID NO: 1714 - protein, 10 aa, Artificial Sequence
  source: /note="Description of Artificial Sequence: Synthetic peptide"
GFTFSSYAMS

SEQ ID NO: 1715 - protein, 10 aa, Artificial Sequence
  source: /note="Description of Artificial Sequence: Synthetic peptide"
GYTFTNFGMN

SEQ ID NO: 1716 - protein, 10 aa, Artificial Sequence
  source: /note="Description of Artificial Sequence: Synthetic peptide"
GYTFTDYSIN

SEQ ID NO: 1717 - protein, 10 aa, Artificial Sequence
  source: /note="Description of Artificial Sequence: Synthetic peptide"
GYTFRHYSMN

SEQ ID NO: 1718 - protein, 10 aa, Artificial Sequence
  source: /note="Description of Artificial Sequence: Synthetic peptide"
GYTFTHYSMN

SEQ ID NO: 1719 - protein, 16 aa, Artificial Sequence
  source: /note="Description of Artificial Sequence: Synthetic peptide"
GIVYSGSTYYAASVKG

SEQ ID NO: 1720 - protein, 17 aa, Artificial Sequence
  source: /note="Description of Artificial Sequence: Synthetic peptide"
GISRSGENTYYADSVKG

SEQ ID NO: 1721 - protein, 17 aa, Artificial Sequence
  source: /note="Description of Artificial Sequence: Synthetic peptide"
GISWNSGSIGYADSVKG

SEQ ID NO: 1722 - protein, 16 aa, Artificial Sequence
  source: /note="Description of Artificial Sequence: Synthetic peptide"
GIVYSGSTYYAASVKG

SEQ ID NO: 1723 - protein, 17 aa, Artificial Sequence
  source: /note="Description of Artificial Sequence: Synthetic peptide"
WINPKNNNTNYAQKFQG

SEQ ID NO: 1724 - protein, 17 aa, Artificial Sequence
  source: /note="Description of Artificial Sequence: Synthetic peptide"
VISGSGGTTYYADSVKG

SEQ ID NO: 1725 - protein, 17 aa, Artificial Sequence
  source: /note="Description of Artificial Sequence: Synthetic peptide"
WISAYNGNTNYAQKFQG

SEQ ID NO: 1726 - protein, 16 aa, Artificial Sequence
  source: /note="Description of Artificial Sequence: Synthetic peptide"
GIVYSGSTYYAASVKG

SEQ ID NO: 1727 - protein, 16 aa, Artificial Sequence
  source: /note="Description of Artificial Sequence: Synthetic peptide"
GIVYSGSTYYAASVKG

SEQ ID NO: 1728 - protein, 16 aa, Artificial Sequence
  source: /note="Description of Artificial Sequence: Synthetic peptide"
GIVYSGSTYYAASVKG

SEQ ID NO: 1729 - protein, 17 aa, Artificial Sequence
  source: /note="Description of Artificial Sequence: Synthetic peptide"
YISSSGSTIYYADSVKG

SEQ ID NO: 1730 - protein, 17 aa, Artificial Sequence
  source: /note="Description of Artificial Sequence: Synthetic peptide"
YISSSGNTIYYADSVKG

SEQ ID NO: 1731 - protein, 16 aa, Artificial Sequence
  source: /note="Description of Artificial Sequence: Synthetic peptide"
GIVYSGSTYYAASVKG

SEQ ID NO: 1732 - protein, 16 aa, Artificial Sequence
  source: /note="Description of Artificial Sequence: Synthetic peptide"
GIVYSGSTYYAASVKG

SEQ ID NO: 1733 - protein, 16 aa, Artificial Sequence
  source: /note="Description of Artificial Sequence: Synthetic peptide"
GIVYSGSTYYAASVKG

SEQ ID NO: 1734 - protein, 16 aa, Artificial Sequence
  source: /note="Description of Artificial Sequence: Synthetic peptide"
SIYYSGSAYYNPSLKS

SEQ ID NO: 1735 - protein, 16 aa, Artificial Sequence
  source: /note="Description of Artificial Sequence: Synthetic peptide"
RIDWDEDKFYSTSLKT

SEQ ID NO: 1736 - protein, 17 aa, Artificial Sequence
  source: /note="Description of Artificial Sequence: Synthetic peptide"
SISSSSSYIYYADSVKG

SEQ ID NO: 1737 - protein, 17 aa, Artificial Sequence
  source: /note="Description of Artificial Sequence: Synthetic peptide"
YISSSGSTIYYADSVKG

SEQ ID NO: 1738 - protein, 17 aa, Artificial Sequence
  source: /note="Description of Artificial Sequence: Synthetic peptide"
MINPSGGVTAYSQTLQG

SEQ ID NO: 1739 - protein, 16 aa, Artificial Sequence
  source: /note="Description of Artificial Sequence: Synthetic peptide"
YIYYSGSTYYNPSLKS

SEQ ID NO: 1740 - protein, 17 aa, Artificial Sequence
  source: /note="Description of Artificial Sequence: Synthetic peptide"
GIIPIFGTANYAQKFQG

SEQ ID NO: 1741 - protein, 18 aa, Artificial Sequence
  source: /note="Description of Artificial Sequence: Synthetic peptide"
RTYYRSKWYSFYAISLKS

SEQ ID NO: 1742 - protein, 17 aa, Artificial Sequence
  source: /note="Description of Artificial Sequence: Synthetic peptide"
AISGSGGSTYYADSVKG

SEQ ID NO: 1743 - protein, 17 aa, Artificial Sequence
  source: /note="Description of Artificial Sequence: Synthetic peptide"
GISDSGVSTYYADSAKG

SEQ ID NO: 1744 - protein, 17 aa, Artificial Sequence
  source: /note="Description of Artificial Sequence: Synthetic peptide"
AISGSGGSTYYADSVKG

SEQ ID NO: 1745 - protein, 17 aa, Artificial Sequence
  source: /note="Description of Artificial Sequence: Synthetic peptide"
AISGSGGSTYYADSVKG

SEQ ID NO: 1746 - protein, 17 aa, Artificial Sequence
  source: /note="Description of Artificial Sequence: Synthetic peptide"
GISWNSGSIGYADSVKG

SEQ ID NO: 1747 - protein, 17 aa, Artificial Sequence
  source: /note="Description of Artificial Sequence: Synthetic peptide"
SINWKGNSLAYGDSVKG

SEQ ID NO: 1748 - protein, 17 aa, Artificial Sequence
  source: /note="Description of Artificial Sequence: Synthetic peptide"
AISGSGGSTYYADSVKG

SEQ ID NO: 1749 - protein, 17 aa, Artificial Sequence
  source: /note="Description of Artificial Sequence: Synthetic peptide"
AISGSGGSTYYADSVKG

SEQ ID NO: 1750 - protein, 17 aa, Artificial Sequence
  source: /note="Description of Artificial Sequence: Synthetic peptide"
AISGSGGSTYYADSVKG

SEQ ID NO: 1751 - protein, 17 aa, Artificial Sequence
  source: /note="Description of Artificial Sequence: Synthetic peptide"
AISGSGGSTYYADSVKG

SEQ ID NO: 1752 - protein, 17 aa, Artificial Sequence
  source: /note="Description of Artificial Sequence: Synthetic peptide"
AISGSGGSTYYADSVKG

SEQ ID NO: 1753 - protein, 17 aa, Artificial Sequence
  source: /note="Description of Artificial Sequence: Synthetic peptide"
AISGSGGSTYYADSVKG

SEQ ID NO: 1754 - protein, 17 aa, Artificial Sequence
  source: /note="Description of Artificial Sequence: Synthetic peptide"
AISGSGGSTYYADSVKG

SEQ ID NO: 1755 - protein, 17 aa, Artificial Sequence
  source: /note="Description of Artificial Sequence: Synthetic peptide"
WINTYTGESYFADDFKG

SEQ ID NO: 1756 - protein, 17 aa, Artificial Sequence
  source: /note="Description of Artificial Sequence: Synthetic peptide"
WINTETREPAYAYDFRG

SEQ ID NO: 1757 - protein, 17 aa, Artificial Sequence
  source: /note="Description of Artificial Sequence: Synthetic peptide"
RINTESGVPIYADDFKG

SEQ ID NO: 1758 - protein, 17 aa, Artificial Sequence
  source: /note="Description of Artificial Sequence: Synthetic peptide"
RINTETGEPLYADDFKG

SEQ ID NO: 1759 - protein, 7 aa, Artificial Sequence
  source: /note="Description of Artificial Sequence: Synthetic peptide"
HGGESDV

SEQ ID NO: 1760 - protein, 11 aa, Artificial Sequence
  source: /note="Description of Artificial Sequence: Synthetic peptide"
SPAHYYGGMDV

SEQ ID NO: 1761 - protein, 6 aa, Artificial Sequence
  source: /note="Description of Artificial Sequence: Synthetic peptide"
HSFLAY

SEQ ID NO: 1762 - protein, 7 aa, Artificial Sequence
  source: /note="Description of Artificial Sequence: Synthetic peptide"
HGGESDV

SEQ ID NO: 1763 - protein, 11 aa, Artificial Sequence
  source: /note="Description of Artificial Sequence: Synthetic peptide"
GPYYYQSYMDV

SEQ ID NO: 1764 - protein, 14 aa, Artificial Sequence
  source: /note="Description of Artificial Sequence: Synthetic peptide"
LDSSGYYYARGPRY

SEQ ID NO: 1765 - protein, 9 aa, Artificial Sequence
  source: /note="Description of Artificial Sequence: Synthetic peptide"
GPYYYYMDV

SEQ ID NO: 1766 - protein, 7 aa, Artificial Sequence
  source: /note="Description of Artificial Sequence: Synthetic peptide"
HGGESDV

SEQ ID NO: 1767 - protein, 7 aa, Artificial Sequence
  source: /note="Description of Artificial Sequence: Synthetic peptide"
HGGESDV

SEQ ID NO: 1768 - protein, 7 aa, Artificial Sequence
  source: /note="Description of Artificial Sequence: Synthetic peptide"
HGGESDV

SEQ ID NO: 1769 - protein, 8 aa, Artificial Sequence
  source: /note="Description of Artificial Sequence: Synthetic peptide"
ESGDGMDV

SEQ ID NO: 1770 - protein, 8 aa, Artificial Sequence
  source: /note="Description of Artificial Sequence: Synthetic peptide"
STMVREDY

SEQ ID NO: 1771 - protein, 7 aa, Artificial Sequence
  source: /note="Description of Artificial Sequence: Synthetic peptide"
HGGESDV

SEQ ID NO: 1772 - protein, 7 aa, Artificial Sequence
  source: /note="Description of Artificial Sequence: Synthetic peptide"
HGGESDV

SEQ ID NO: 1773 - protein, 7 aa, Artificial Sequence
  source: /note="Description of Artificial Sequence: Synthetic peptide"
HGGESDV

SEQ ID NO: 1774 - protein, 11 aa, Artificial Sequence
  source: /note="Description of Artificial Sequence: Synthetic peptide"
HWQEWPDAFDI

SEQ ID NO: 1775 - protein, 13 aa, Artificial Sequence
  source: /note="Description of Artificial Sequence: Synthetic peptide"
SGAGGTSATAFDI

SEQ ID NO: 1776 - protein, 10 aa, Artificial Sequence
  source: /note="Description of Artificial Sequence: Synthetic peptide"
TIAAVYAFDI

SEQ ID NO: 1777 - protein, 8 aa, Artificial Sequence
  source: /note="Description of Artificial Sequence: Synthetic peptide"
DLRGAFDI

SEQ ID NO: 1778 - protein, 11 aa, Artificial Sequence
  source: /note="Description of Artificial Sequence: Synthetic peptide"
EGSGSGWYFDF

SEQ ID NO: 1779 - protein, 13 aa, Artificial Sequence
  source: /note="Description of Artificial Sequence: Synthetic peptide"
AGIAARLRGAFDI

SEQ ID NO: 1780 - protein, 20 aa, Artificial Sequence
  source: /note="Description of Artificial Sequence: Synthetic peptide"
RGGYQLLRWDVGLLRSAFDI

SEQ ID NO: 1781 - protein, 13 aa, Artificial Sequence
  source: /note="Description of Artificial Sequence: Synthetic peptide"
SSPEGLFLYWFDP

SEQ ID NO: 1782 - protein, 9 aa, Artificial Sequence
  source: /note="Description of Artificial Sequence: Synthetic peptide"
VEGSGSLDY

SEQ ID NO: 1783 - protein, 9 aa, Artificial Sequence
  source: /note="Description of Artificial Sequence: Synthetic peptide"
RAGSEASDI

SEQ ID NO: 1784 - protein, 15 aa, Artificial Sequence
  source: /note="Description of Artificial Sequence: Synthetic peptide"
ATYKRELRYYYGMDV

SEQ ID NO: 1785 - protein, 15 aa, Artificial Sequence
  source: /note="Description of Artificial Sequence: Synthetic peptide"
ATYKRELRYYYGMDV

SEQ ID NO: 1786 - protein, 8 aa, Artificial Sequence
  source: /note="Description of Artificial Sequence: Synthetic peptide"
VGKAVPDV

SEQ ID NO: 1787 - protein, 13 aa, Artificial Sequence
  source: /note="Description of Artificial Sequence: Synthetic peptide"
HQGVAYYNYAMDV

SEQ ID NO: 1788 - protein, 8 aa, Artificial Sequence
  source: /note="Description of Artificial Sequence: Synthetic peptide"
VVRDGMDV

SEQ ID NO: 1789 - protein, 9 aa, Artificial Sequence
  source: /note="Description of Artificial Sequence: Synthetic peptide"
IPQTGTFDY

SEQ ID NO: 1790 - protein, 15 aa, Artificial Sequence
  source: /note="Description of Artificial Sequence: Synthetic peptide"
ANYKRELRYYYGMDV

SEQ ID NO: 1791 - protein, 11 aa, Artificial Sequence
  source: /note="Description of Artificial Sequence: Synthetic peptide"
ALVGATGAFDI

SEQ ID NO: 1792 - protein, 8 aa, Artificial Sequence
  source: /note="Description of Artificial Sequence: Synthetic peptide"
WFGEGFDP

SEQ ID NO: 1793 - protein, 17 aa, Artificial Sequence
  source: /note="Description of Artificial Sequence: Synthetic peptide"
VGYDSSGYYRDYYGMDV

SEQ ID NO: 1794 - protein, 13 aa, Artificial Sequence
  source: /note="Description of Artificial Sequence: Synthetic peptide"
MGWSSGYLGAFDI

SEQ ID NO: 1795 - protein, 13 aa, Artificial Sequence
  source: /note="Description of Artificial Sequence: Synthetic peptide"
GEIYYGYDGGFAY

SEQ ID NO: 1796 - protein, 8 aa, Artificial Sequence
  source: /note="Description of Artificial Sequence: Synthetic peptide"
DYSYAMDY

SEQ ID NO: 1797 - protein, 8 aa, Artificial Sequence
  source: /note="Description of Artificial Sequence: Synthetic peptide"
DYLYSLDF

SEQ ID NO: 1798 - protein, 8 aa, Artificial Sequence
  source: /note="Description of Artificial Sequence: Synthetic peptide"
DYLYSCDY

SEQ ID NO: 1799 - protein, 11 aa, Artificial Sequence
  source: /note="Description of Artificial Sequence: Synthetic peptide"
RASQSISSYLN

SEQ ID NO: 1800 - protein, 12 aa, Artificial Sequence
  source: /note="Description of Artificial Sequence: Synthetic peptide"
RASQSISSSFLA

SEQ ID NO: 1801 - protein, 16 aa, Artificial Sequence
  source: /note="Description of Artificial Sequence: Synthetic peptide"
RSSQSLLHSNGYNYLD

SEQ ID NO: 1802 - protein, 16 aa, Artificial Sequence
  source: /note="Description of Artificial Sequence: Synthetic peptide"
KSSQSLLRNDGKTPLY

SEQ ID NO: 1803 - protein, 16 aa, Artificial Sequence
  source: /note="Description of Artificial Sequence: Synthetic peptide"
RSSQSLLHSNGYNYLN

SEQ ID NO: 1804 - protein, 11 aa, Artificial Sequence
  source: /note="Description of Artificial Sequence: Synthetic peptide"
RASQSISSYLN

SEQ ID NO: 1805 - protein, 16 aa, Artificial Sequence
  source: /note="Description of Artificial Sequence: Synthetic peptide"
RSSQSLLYSNGYNYVD

SEQ ID NO: 1806 - protein, 11 aa, Artificial Sequence
  source: /note="Description of Artificial Sequence: Synthetic peptide"
RASQSVSSNLA

SEQ ID NO: 1807 - protein, 11 aa, Artificial Sequence
  source: /note="Description of Artificial Sequence: Synthetic peptide"
RASQSVSSKLA

SEQ ID NO: 1808 - protein, 12 aa, Artificial Sequence
  source: /note="Description of Artificial Sequence: Synthetic peptide"
RASQSVGSTNLA

SEQ ID NO: 1809 - protein, 11 aa, Artificial Sequence
  source: /note="Description of Artificial Sequence: Synthetic peptide"
RASQSISSYLN

SEQ ID NO: 1810 - protein, 16 aa, Artificial Sequence
  source: /note="Description of Artificial Sequence: Synthetic peptide"
KSSESLVHNSGKTYLN

SEQ ID NO: 1811 - protein, 11 aa, Artificial Sequence
  source: /note="Description of Artificial Sequence: Synthetic peptide"
QASEDINKFLN

SEQ ID NO: 1812 - protein, 11 aa, Artificial Sequence
  source: /note="Description of Artificial Sequence: Synthetic peptide"
RASQSVGSNLA

SEQ ID NO: 1813 - protein, 12 aa, Artificial Sequence
  source: /note="Description of Artificial Sequence: Synthetic peptide"
RASQSIGSSSLA

SEQ ID NO: 1814 - protein, 11 aa, Artificial Sequence
  source: /note="Description of Artificial Sequence: Synthetic peptide"
KASQDIDDAMN

SEQ ID NO: 1815 - protein, 11 aa, Artificial Sequence
  source: /note="Description of Artificial Sequence: Synthetic peptide"
RASQDIYNNLA

SEQ ID NO: 1816 - protein, 16 aa, Artificial Sequence
  source: /note="Description of Artificial Sequence: Synthetic peptide"
RSSQSLLHSNGYNYLD

SEQ ID NO: 1817 - protein, 11 aa, Artificial Sequence
  source: /note="Description of Artificial Sequence: Synthetic peptide"
GGNNIGTKSVH

SEQ ID NO: 1818 - protein, 11 aa, Artificial Sequence
  source: /note="Description of Artificial Sequence: Synthetic peptide"
SGDGLSKKYVS

SEQ ID NO: 1819 - protein, 11 aa, Artificial Sequence
  source: /note="Description of Artificial Sequence: Synthetic peptide"
RASQGIRNWLA

SEQ ID NO: 1820 - protein, 11 aa, Artificial Sequence
  source: /note="Description of Artificial Sequence: Synthetic peptide"
GGNNIGSKSVH

SEQ ID NO: 1821 - protein, 11 aa, Artificial Sequence
  source: /note="Description of Artificial Sequence: Synthetic peptide"
QGDSLGNYYAT

SEQ ID NO: 1822 - protein, 12 aa, Artificial Sequence
  source: /note="Description of Artificial Sequence: Synthetic peptide"
RASQSVSSAYLA

SEQ ID NO: 1823 - protein, 11 aa, Artificial Sequence
  source: /note="Description of Artificial Sequence: Synthetic peptide"
RASQSVSNSLA

SEQ ID NO: 1824 - protein, 12 aa, Artificial Sequence
  source: /note="Description of Artificial Sequence: Synthetic peptide"
RASQSVSSSFLA

SEQ ID NO: 1825 - protein, 12 aa, Artificial Sequence
  source: /note="Description of Artificial Sequence: Synthetic peptide"
RASQSVSTTFLA

SEQ ID NO: 1826 - protein, 11 aa, Artificial Sequence
  source: /note="Description of Artificial Sequence: Synthetic peptide"
RASQSISSYLN

SEQ ID NO: 1827 - protein, 12 aa, Artificial Sequence
  source: /note="Description of Artificial Sequence: Synthetic peptide"
RATQSIGSSFLA

SEQ ID NO: 1828 - protein, 12 aa, Artificial Sequence
  source: /note="Description of Artificial Sequence: Synthetic peptide"
RASQSVSSSYLA

SEQ ID NO: 1829 - protein, 12 aa, Artificial Sequence
  source: /note="Description of Artificial Sequence: Synthetic peptide"
RASQSVSSSYLA

SEQ ID NO: 1830 - protein, 12 aa, Artificial Sequence
  source: /note="Description of Artificial Sequence: Synthetic peptide"
RASQRVASNYLA

SEQ ID NO: 1831 - protein, 12 aa, Artificial Sequence
  source: /note="Description of Artificial Sequence: Synthetic peptide"
RASQSLSSNFLA

SEQ ID NO: 1832 - protein, 16 aa, Artificial Sequence
  source: /note="Description of Artificial Sequence: Synthetic peptide"
RSSQSLLHSNGYNYLD

SEQ ID NO: 1833 - protein, 12 aa, Artificial Sequence
  source: /note="Description of Artificial Sequence: Synthetic peptide"
RASQSVSSSYLA

SEQ ID NO: 1834 - protein, 12 aa, Artificial Sequence
  source: /note="Description of Artificial Sequence: Synthetic peptide"
RASQSVASSFLA

SEQ ID NO: 1835 - protein, 11 aa, Artificial Sequence
  source: /note="Description of Artificial Sequence: Synthetic peptide"
RASQDVNTAVS

SEQ ID NO: 1836 - protein, 15 aa, Artificial Sequence
  source: /note="Description of Artificial Sequence: Synthetic peptide"
RASESVSVIGAHLIH

SEQ ID NO: 1837 - protein, 15 aa, Artificial Sequence
  source: /note="Description of Artificial Sequence: Synthetic peptide"
RASESVTILGSHLIY

SEQ ID NO: 1838 - protein, 15 aa, Artificial Sequence
  source: /note="Description of Artificial Sequence: Synthetic peptide"
RASESVTILGSHLIY

SEQ ID NO: 1839 - protein, 7 aa, Artificial Sequence
  source: /note="Description of Artificial Sequence: Synthetic peptide"
AASSLQS

SEQ ID NO: 1840 - protein, 7 aa, Artificial Sequence
  source: /note="Description of Artificial Sequence: Synthetic peptide"
GASRRAT

SEQ ID NO: 1841 - protein, 7 aa, Artificial Sequence
  source: /note="Description of Artificial Sequence: Synthetic peptide"
LGSNRAS

SEQ ID NO: 1842 - protein, 7 aa, Artificial Sequence
  source: /note="Description of Artificial Sequence: Synthetic peptide"
EVSNRFS

SEQ ID NO: 1843 - protein, 7 aa, Artificial Sequence
  source: /note="Description of Artificial Sequence: Synthetic peptide"
LGSKRAS

SEQ ID NO: 1844 - protein, 7 aa, Artificial Sequence
  source: /note="Description of Artificial Sequence: Synthetic peptide"
GASTLAS

SEQ ID NO: 1845 - protein, 7 aa, Artificial Sequence
  source: /note="Description of Artificial Sequence: Synthetic peptide"
LGSNRAS

SEQ ID NO: 1846 - protein, 7 aa, Artificial Sequence
  source: /note="Description of Artificial Sequence: Synthetic peptide"
GASTRAS

SEQ ID NO: 1847 - protein, 7 aa, Artificial Sequence
  source: /note="Description of Artificial Sequence: Synthetic peptide"
GASIRAT

SEQ ID NO: 1848 - protein, 7 aa, Artificial Sequence
  source: /note="Description of Artificial Sequence: Synthetic peptide"
DASNRAT

SEQ ID NO: 1849 - protein, 7 aa, Artificial Sequence
  source: /note="Description of Artificial Sequence: Synthetic peptide"
AASSLQS

SEQ ID NO: 1850 - protein, 7 aa, Artificial Sequence
  source: /note="Description of Artificial Sequence: Synthetic peptide"
EVSNRDS

SEQ ID NO: 1851 - protein, 7 aa, Artificial Sequence
  source: /note="Description of Artificial Sequence: Synthetic peptide"
DASTLQT

SEQ ID NO: 1852 - protein, 7 aa, Artificial Sequence
  source: /note="Description of Artificial Sequence: Synthetic peptide"
GASTRAT

SEQ ID NO: 1853 - protein, 7 aa, Artificial Sequence
  source: /note="Description of Artificial Sequence: Synthetic peptide"
GASSRAS

SEQ ID NO: 1854 - protein, 7 aa, Artificial Sequence
  source: /note="Description of Artificial Sequence: Synthetic peptide"
SATSPVP

SEQ ID NO: 1855 - protein, 7 aa, Artificial Sequence
  source: /note="Description of Artificial Sequence: Synthetic peptide"
AANKSQS

SEQ ID NO: 1856 - protein, 7 aa, Artificial Sequence
  source: /note="Description of Artificial Sequence: Synthetic peptide"
LGSNRAS

SEQ ID NO: 1857 - protein, 7 aa, Artificial Sequence
  source: /note="Description of Artificial Sequence: Synthetic peptide"
DDSVRPS

SEQ ID NO: 1858 - protein, 7 aa, Artificial Sequence
  source: /note="Description of Artificial Sequence: Synthetic peptide"
RDKERPS

SEQ ID NO: 1859 - protein, 7 aa, Artificial Sequence
  source: /note="Description of Artificial Sequence: Synthetic peptide"
AASNLQS

SEQ ID NO: 1860 - protein, 7 aa, Artificial Sequence
  source: /note="Description of Artificial Sequence: Synthetic peptide"
GKNNRPS

SEQ ID NO: 1861 - protein, 7 aa, Artificial Sequence
  source: /note="Description of Artificial Sequence: Synthetic peptide"
GTNNRPS

SEQ ID NO: 1862 - protein, 7 aa, Artificial Sequence
  source: /note="Description of Artificial Sequence: Synthetic peptide"
GASTRAT

SEQ ID NO: 1863 - protein, 7 aa, Artificial Sequence
  source: /note="Description of Artificial Sequence: Synthetic peptide"
DASSRAT

SEQ ID NO: 1864 - protein, 7 aa, Artificial Sequence
  source: /note="Description of Artificial Sequence: Synthetic peptide"
GASSRAT

SEQ ID NO: 1865 - protein, 7 aa, Artificial Sequence
  source: /note="Description of Artificial Sequence: Synthetic peptide"
GSSNRAT

SEQ ID NO: 1866 - protein, 7 aa, Artificial Sequence
  source: /note="Description of Artificial Sequence: Synthetic peptide"
AASSLQS

SEQ ID NO: 1867 - protein, 7 aa, Artificial Sequence
  source: /note="Description of Artificial Sequence: Synthetic peptide"
GASQRAT

SEQ ID NO: 1868 - protein, 7 aa, Artificial Sequence
  source: /note="Description of Artificial Sequence: Synthetic peptide"
GASSRAT

SEQ ID NO: 1869 - protein, 7 aa, Artificial Sequence
  source: /note="Description of Artificial Sequence: Synthetic peptide"
GASSRAT

SEQ ID NO: 1870 - protein, 7 aa, Artificial Sequence
  source: /note="Description of Artificial Sequence: Synthetic peptide"
GASSRAT

SEQ ID NO: 1871 - protein, 7 aa, Artificial Sequence
  source: /note="Description of Artificial Sequence: Synthetic peptide"
GASNWAT

SEQ ID NO: 1872 - protein, 7 aa, Artificial Sequence
  source: /note="Description of Artificial Sequence: Synthetic peptide"
LGSNRAS

SEQ ID NO: 1873 - protein, 7 aa, Artificial Sequence
  source: /note="Description of Artificial Sequence: Synthetic peptide"
GTSSRAT

SEQ ID NO: 1874 - protein, 7 aa, Artificial Sequence
  source: /note="Description of Artificial Sequence: Synthetic peptide"
GASGRAT

SEQ ID NO: 1875 - protein, 7 aa, Artificial Sequence
  source: /note="Description of Artificial Sequence: Synthetic peptide"
SASYRYT

SEQ ID NO: 1876 - protein, 7 aa, Artificial Sequence
  source: /note="Description of Artificial Sequence: Synthetic peptide"
LASNLET

SEQ ID NO: 1877 - protein, 7 aa, Artificial Sequence
  source: /note="Description of Artificial Sequence: Synthetic peptide"
LASNVQT

SEQ ID NO: 1878 - protein, 7 aa, Artificial Sequence
  source: /note="Description of Artificial Sequence: Synthetic peptide"
LASNVQT

SEQ ID NO: 1879 - protein, 9 aa, Artificial Sequence
  source: /note="Description of Artificial Sequence: Synthetic peptide"
QQSYSTPYT

SEQ ID NO: 1880 - protein, 10 aa, Artificial Sequence
  source: /note="Description of Artificial Sequence: Synthetic peptide"
QQYHSSPSWT

SEQ ID NO: 1881 - protein, 9 aa, Artificial Sequence
  source: /note="Description of Artificial Sequence: Synthetic peptide"
MQALQTPYT

SEQ ID NO: 1882 - protein, 8 aa, Artificial Sequence
  source: /note="Description of Artificial Sequence: Synthetic peptide"
MQNIQFPS

SEQ ID NO: 1883 - protein, 9 aa, Artificial Sequence
  source: /note="Description of Artificial Sequence: Synthetic peptide"
MQALQTPYT

SEQ ID NO: 1884 - protein, 8 aa, Artificial Sequence
  source: /note="Description of Artificial Sequence: Synthetic peptide"
QQSYKRAS

SEQ ID NO: 1885 - protein, 9 aa, Artificial Sequence
  source: /note="Description of Artificial Sequence: Synthetic peptide"
MQGRQFPYS

SEQ ID NO: 1886 - protein, 8 aa, Artificial Sequence
  source: /note="Description of Artificial Sequence: Synthetic peptide"
QQYGSSLT

SEQ ID NO: 1887 - protein, 9 aa, Artificial Sequence
  source: /note="Description of Artificial Sequence: Synthetic peptide"
QQYGSSSWT

SEQ ID NO: 1888 - protein, 10 aa, Artificial Sequence
  source: /note="Description of Artificial Sequence: Synthetic peptide"
QQYGSSPPWT

SEQ ID NO: 1889 - protein, 7 aa, Artificial Sequence
  source: /note="Description of Artificial Sequence: Synthetic peptide"
QQSYTLA

SEQ ID NO: 1890 - protein, 9 aa, Artificial Sequence
  source: /note="Description of Artificial Sequence: Synthetic peptide"
MQGTHWPGT

SEQ ID NO: 1891 - protein, 9 aa, Artificial Sequence
  source: /note="Description of Artificial Sequence: Synthetic peptide"
QQYESLPLT

SEQ ID NO: 1892 - protein, 10 aa, Artificial Sequence
  source: /note="Description of Artificial Sequence: Synthetic peptide"
QQYNDWLPVT

SEQ ID NO: 1893 - protein, 10 aa, Artificial Sequence
  source: /note="Description of Artificial Sequence: Synthetic peptide"
QQYAGSPPFT

SEQ ID NO: 1894 - protein, 9 aa, Artificial Sequence
  source: /note="Description of Artificial Sequence: Synthetic peptide"
LQHDNFPLT

SEQ ID NO: 1895 - protein, 9 aa, Artificial Sequence
  source: /note="Description of Artificial Sequence: Synthetic peptide"
QHYYRFPYS

SEQ ID NO: 1896 - protein, 9 aa, Artificial Sequence
  source: /note="Description of Artificial Sequence: Synthetic peptide"
MQALQTPYT

SEQ ID NO: 1897 - protein, 11 aa, Artificial Sequence
  source: /note="Description of Artificial Sequence: Synthetic peptide"
QVWDSDSEHVV

SEQ ID NO: 1898 - protein, 9 aa, Artificial Sequence
  source: /note="Description of Artificial Sequence: Synthetic peptide"
QAWDDTTVV

SEQ ID NO: 1899 - protein, 9 aa, Artificial Sequence
  source: /note="Description of Artificial Sequence: Synthetic peptide"
QKYNSAPFT

SEQ ID NO: 1900 - protein, 12 aa, Artificial Sequence
  source: /note="Description of Artificial Sequence: Synthetic peptide"
SSRDSSGDHLRV

SEQ ID NO: 1901 - protein, 11 aa, Artificial Sequence
  source: /note="Description of Artificial Sequence: Synthetic peptide"
NSRDSSGHHLL

SEQ ID NO: 1902 - protein, 14 aa, Artificial Sequence
  source: /note="Description of Artificial Sequence: Synthetic peptide"
QHYGSSFNGSSLFT

SEQ ID NO: 1903 - protein, 10 aa, Artificial Sequence
  source: /note="Description of Artificial Sequence: Synthetic peptide"
QQFGTSSGLT

SEQ ID NO: 1904 - protein, 10 aa, Artificial Sequence
  source: /note="Description of Artificial Sequence: Synthetic peptide"
QQYHSSPSWT

SEQ ID NO: 1905 - protein, 10 aa, Artificial Sequence
  source: /note="Description of Artificial Sequence: Synthetic peptide"
QQYHSSPSWT

SEQ ID NO: 1906 - protein, 9 aa, Artificial Sequence
  source: /note="Description of Artificial Sequence: Synthetic peptide"
QQSYSTPYS

SEQ ID NO: 1907 - protein, 10 aa, Artificial Sequence
  source: /note="Description of Artificial Sequence: Synthetic peptide"
QHYESSPSWT

SEQ ID NO: 1908 - protein, 10 aa, Artificial Sequence
  source: /note="Description of Artificial Sequence: Synthetic peptide"
QQYGSPPRFT

SEQ ID NO: 1909 - protein, 10 aa, Artificial Sequence
  source: /note="Description of Artificial Sequence: Synthetic peptide"
QHYGSSPSWT

SEQ ID NO: 1910 - protein, 10 aa, Artificial Sequence
  source: /note="Description of Artificial Sequence: Synthetic peptide"
QHYDSSPSWT

SEQ ID NO: 1911 - protein, 10 aa, Artificial Sequence
  source: /note="Description of Artificial Sequence: Synthetic peptide"
QYYGTSPMYT

SEQ ID NO: 1912 - protein, 9 aa, Artificial Sequence
  source: /note="Description of Artificial Sequence: Synthetic peptide"
MQALQTPLT

SEQ ID NO: 1913 - protein, 11 aa, Artificial Sequence
  source: /note="Description of Artificial Sequence: Synthetic peptide"
QHYGNSPPKFT

SEQ ID NO: 1914 - protein, 10 aa, Artificial Sequence
  source: /note="Description of Artificial Sequence: Synthetic peptide"
QHYGGSPRLT

SEQ ID NO: 1915 - protein, 9 aa, Artificial Sequence
  source: /note="Description of Artificial Sequence: Synthetic peptide"
QQHYSTPWT

SEQ ID NO: 1916 - protein, 9 aa, Artificial Sequence
  source: /note="Description of Artificial Sequence: Synthetic peptide"
LQSRIFPRT

SEQ ID NO: 1917 - protein, 9 aa, Artificial Sequence
  source: /note="Description of Artificial Sequence: Synthetic peptide"
LQSRTIPRT

SEQ ID NO: 1918 - protein, 9 aa, Artificial Sequence
  source: /note="Description of Artificial Sequence: Synthetic peptide"
LQSRTIPRT

SEQ ID NO: 1919 - protein, 21 aa, Artificial Sequence
  source: /note="Description of Artificial Sequence: Synthetic peptide"
MALPVTALLLPLALLLHAARP

SEQ ID NO: 1920 - DNA, 63 bp, Artificial Sequence; identical to SEQ ID NO: 402
  source: /note="Description of Artificial Sequence: Synthetic oligonucleotide"

SEQ ID NO: 1921 - protein, 45 aa, Artificial Sequence; identical to SEQ ID NO: 403
  source: /note="Description of Artificial Sequence: Synthetic polypeptide"

SEQ ID NO: 1922 - DNA, 135 bp, Artificial Sequence; identical to SEQ ID NO: 404
  source: /note="Description of Artificial Sequence: Synthetic polynucleotide"

SEQ ID NO: 1923 - protein, 24 aa, Artificial Sequence
  source: /note="Description of Artificial Sequence: Synthetic peptide"
IYIWAPLAGTCGVLLLSLVITLYC

SEQ ID NO: 1924 - DNA, 72 bp, Artificial Sequence; identical to SEQ ID NO: 13
  source: /note="Description of Artificial Sequence: Synthetic oligonucleotide"

SEQ ID NO: 1925 - protein, 42 aa, Artificial Sequence; identical to SEQ ID NO: 14
  source: /note="Description of Artificial Sequence: Synthetic polypeptide"

SEQ ID NO: 1926 - DNA, 126 bp, Artificial Sequence; identical to SEQ ID NO: 15
  source: /note="Description of Artificial Sequence: Synthetic polynucleotide"

SEQ ID NO: 1927 - protein, 41 aa, Artificial Sequence; identical to SEQ ID NO: 5
  source: /note="Description of Artificial Sequence: Synthetic polypeptide"

SEQ ID NO: 1928 - DNA, 123 bp, Artificial Sequence; identical to SEQ ID NO: 6
  source: /note="Description of Artificial Sequence: Synthetic polynucleotide"

SEQ ID NO: 1929 - protein, 35 aa, Artificial Sequence
  source: /note="Description of Artificial Sequence: Synthetic polypeptide"
TKKKYSSSVHDPNGEYMFMRAVNTAKKSRLTDVTL

SEQ ID NO: 1930 - DNA, 105 bp, Artificial Sequence
  source: /note="Description of Artificial Sequence: Synthetic polynucleotide"
acaaaaaagaagtattcatccagtgtgcacgaccctaacggtgaatacatgttcatgagagcagtgaacacagccaaaaaatccagactcacagatgtgacccta

SEQ ID NO: 1931 - protein, 112 aa, Artificial Sequence; identical to SEQ ID NO: 18
  source: /note="Description of Artificial Sequence: Synthetic polypeptide"

SEQ ID NO: 1932 - DNA, 336 bp, Artificial Sequence; identical to SEQ ID NO: 19
  source: /note="Description of Artificial Sequence: Synthetic polynucleotide"

SEQ ID NO: 1933 - protein, 112 aa, Artificial Sequence; identical to SEQ ID NO: 20
  source: /note="Description of Artificial Sequence: Synthetic polypeptide"

SEQ ID NO: 1934 - DNA, 336 bp, Artificial Sequence; identical to SEQ ID NO: 21
  source: /note="Description of Artificial Sequence: Synthetic polynucleotide"

SEQ ID NO: 1935 - protein, 230 aa, Artificial Sequence; identical to SEQ ID NO: 405
  source: /note="Description of Artificial Sequence: Synthetic polypeptide"

SEQ ID NO: 1936 - DNA, 690 bp, Artificial Sequence; identical to SEQ ID NO: 406
  source: /note="Description of Artificial Sequence: Synthetic polynucleotide"

SEQ ID NO: 1937 - protein, 4 aa, Artificial Sequence
  source: /note="Description of Artificial Sequence: Synthetic peptide"
YMFM

SEQ ID NO: 1938 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1939 - protein, 439 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 1940 - protein, 819 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 1941 - protein, 467 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1942 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 1943 - DNA, 63 bp, Artificial Sequence
  source: /note="Description of Artificial Sequence: Synthetic oligonucleotide"
atggccctccctgtcaccgccctgctgcttccgctggctcttctgctccacgccgctcggccc

SEQ ID NO: 1944 - DNA, 72 bp, Artificial Sequence
  source: /note="Description of Artificial Sequence: Synthetic oligonucleotide"
atctacatttgggcccctctggctggtacttgcggggtcctgctgctttcactcgtgatcactctttactgt

SEQ ID NO: 1945 - DNA, 126 bp, Artificial Sequence
  source: /note="Description of Artificial Sequence: Synthetic polynucleotide"
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 1946 - DNA, 336 bp, Artificial Sequence
  source: /note="Description of Artificial Sequence: Synthetic polynucleotide"
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1947 - protein, 4 aa, Artificial Sequence
  source: /note="Description of Artificial Sequence: Synthetic peptide"
YMNM

SEQ ID NO: 1948 - protein, 4 aa, Artificial Sequence
  source: /note="Description of Artificial Sequence: Synthetic peptide"
FMNM

SEQ ID NO: 1949 - protein, 4 aa, Artificial Sequence
  source: /note="Description of Artificial Sequence: Synthetic peptide"
FMFM

SEQ ID NO: 1950 - protein, 31 aa, Artificial Sequence
  source: /note="Description of Artificial Sequence: Synthetic polypeptide"
KYSSSVHDPNGEYMFMRAVNTAKKSRLTDVT

What is claimed is:

1. A chimeric antigen receptor (CAR) molecule comprising:
   i) an antigen binding domain,
   ii) a transmembrane domain, and
   iii) an intracellular domain that comprises a costimulatory domain that comprises the amino acid sequence of RSKRSRLLHSDX$_1$MX$_2$MTPRRPGPTRKHYQPYA PPRDFAAYRS (SEQ ID NO: 1), a sequence at least 95% identical thereto, or a sequence with no more than 1, 2, 3, or 4 modifications of SEQ ID NO: 1 and wherein
   X$_1$ is any amino acid, and
   X$_2$ is selected from R (Arg), C (Cys), E (Glu), G (Gly), H (His), I (Ile), L (Leu), M (Met), F (Phe), S (Ser), T (Thr), W (Trp), Y (Tyr), or V (Val), provided that SEQ ID NO: 1 is not RSKRSRLLHSDYMNMTPRRPGPTRKHYQPYAP-PRDFAAYRS (SEQ ID NO: 5).

2. The CAR molecule of claim 1, wherein the intracellular domain further comprises a primary signaling domain.

3. The CAR molecule of claim 1, which has reduced Grb2 binding compared to an otherwise similar CAR molecule comprising the wild-type CD28 amino acid sequence of SEQ ID NO: 5.

4. The CAR molecule of claim 1 further comprising a primary signaling domain which is a functional signaling domain of CD3 zeta, wherein said CAR has at least 2, 3, 4, 5, 6, 7, 8, 9, 10, 11, 12, 13, 14, or all of the following properties:
   a) T cells comprising the CAR molecule produce a reduction in tumor load compared to otherwise similar cells comprising a control CAR molecule;
   b) T cells comprising the CAR molecule produce IL-2 at a level no less than about 95%, 90%, 80%, 70%, 60%, 50%, 40%, or 30% of that produced by otherwise similar cells comprising a control CAR molecule;
   c) T cells comprising the CAR molecule produce TNF-alpha at a level no less than about 95%, 90%, 80%, 70%, 60%, 50%, 40%, or 30%, of that produced by otherwise similar cells comprising a control CAR molecule;
   d) T cells comprising the CAR molecule produce IFN-gamma at a level no less than about 95%, 90%, 80%, 70%, 60%, 50%, 40%, or 30% of that produced by otherwise similar cells comprising a control CAR molecule;
   e) T cells comprising the CAR molecule produce GM-CSF at a level no less than about 95%, 90%, 80%, 70%, 60%, 50%, 40%, or 30% of that produced by otherwise similar cells comprising a control CAR molecule
   f) T cells comprising the CAR molecule produce a reduction in tumor volume of a least about 5%, 10%, 20%, 30%, 40%, 50%, 60%, 70%, 80%, or 90% compared to non-treated mice in a pancreatic tumor assay described in Example 4;
   g) T cells comprising the CAR molecule show a persistence of at least 50, 60, 70, 80, 90, 100, 120, or 130 CD4+ T cells/ul of blood, 30 days after administration, in a persistence assay described in Example 4;
   h) T cells comprising the CAR molecule show a persistence of at least 50, 60, 70, 80, 90, 100, 120, or 130 CD8+ T cells/ul of blood, 30 days after administration, in a persistence assay described in Example 4;
   i) T cells comprising the CAR molecule show a persistence of at least 3000, 4000, 5000, 6000, or 7000 CD4+ T cells/ul of blood, 60 days after administration, in a persistence assay described in Example 4;
   j) T cells comprising the CAR molecule show a persistence of at least 600, 800, 1000, or 1200 CD8+ T cells/ul of blood, 60 days after administration, in a persistence assay described in Example 4;
   k) T cells comprising the CAR molecule show a reduction in calcium flux of at least 10%, 20%, 30%, 40%, 50%, or 60%, compared to otherwise similar cells comprising a control CAR molecule;
   l) T cells comprising the CAR molecule produce ROS at a level no more than 40%, 50%, 60%, 70%, or 80% of that produced by otherwise similar cells comprising a control CAR molecule;
   m) T cells comprising the CAR molecule show a reduction of at least 30%, 40%, 50%, or 60%, in expression or transcription of exhaustion marker Tox2 compared to otherwise similar cells comprising a control CAR molecule
   n) T cells comprising the CAR molecule show a reduction in phosphorylation of Vav, PLCγ, or ERK, of at least 10%, 20%, 30%, 40%, 50%, or 60%, compared to otherwise similar cells comprising a control CAR molecule; or
   o) T cells comprising the CAR molecule show an increase in phosphorylation of AKT, of at least 30%, 60%, 100%, 150%, or 200%, compared to otherwise similar cells comprising a control CAR molecule.

5. The CAR molecule of claim 1 further comprising a primary signaling domain which is a functional signaling domain of CD3 zeta, wherein said CAR has at least 2, 3 or all the following properties:
   a) the CAR molecule binds PI3-kinase with at least about the same affinity as an otherwise similar CAR molecule comprising the wild-type CD28 amino acid sequence of SEQ ID NO: 5 binds to PI3-kinase;
   b) the CAR molecule mediates costimulation to at least about the same extent as an otherwise similar CAR molecule comprising the wild-type CD28 amino acid sequence of SEQ ID NO: 5;
   c) the CAR molecule promotes T cell activation to at least about the same extent as an otherwise similar CAR molecule comprising the wild-type CD28 amino acid sequence of SEQ ID NO: 5; or
   d) the CAR molecule promotes IL-2 secretion by at least about the same amount as an otherwise similar CAR molecule comprising the wild-type CD28 amino acid sequence of SEQ ID NO: 5.

6. The CAR molecule of claim 1, wherein: (i) $X_1$ is an amino acid that is a conservative amino acid substitution relative to the same position in SEQ ID NO: 5;
   (ii) $X_1$ is an amino acid selected from Y (Tyr), F (Phe), and W (Trp);
   (iii) $X_2$ is F (Phe);
   (iv) $X_1$ is Y (Tyr); or
   (v) $X_1$ is Y (Tyr) and $X_2$ is F (Phe).

7. The CAR molecule of claim 1, which comprises the amino acid sequence:

```
                                          (SEQ ID NO: 2)
RSKRSRLLHSDYMFMTPRRPGPTRKHYQPYAPPRDFAAYRS;

(SEQ ID NO: 3)
RSKRSRLLHSDFMNMTPRRPGPTRKHYQPYAPPRDFAAYRS; or (SEQ ID NO: 4)
RSKRSRLLHSDFMFMTPRRPGPTRKHYQPYAPPRDFAAYRS.
```

8. The CAR molecule of claim 1, wherein the antigen binding domain binds a tumor antigen chosen: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8) aNeu5Ac(2-3)bDGalp(1-4)bDGlcp(1-1)Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B 1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

9. The CAR molecule of claim 1, wherein the antigen binding domain binds a tumor antigen chosen from CD150, 5T4, ActRIIA, B7, BMCA, CA-125, CCNA1, CD123, CD126, CD138, CD14, CD148, CD15, CD19, CD20, CD200, CD21, CD22, CD23, CD24, CD25, CD26, CD261, CD262, CD30, CD33, CD362, CD37, CD38, CD4, CD40, CD40L, CD44, CD46, CD5, CD52, CD53, CD54, CD56, CD66a-d, CD74, CD8, CD80, CD92, CE7, CS-1, CSPG4, ED-B fibronectin, EGFR, EGFRvIII, EGP-2, EGP-4, EPHa2, ErbB2, ErbB3, ErbB4, FBP, GD2, GD3, HER1-HER2 in combination, HER2-HER3 in combination, HERV-K, HIV-1 envelope glycoprotein gp120, HIV-1 envelope glycoprotein gp41, HLA-DR, HM1.24, HMW-MAA, Her2, Her2/neu, IGF-1R, IL-11Ralpha, IL-13R-alpha2, IL-2, IL-22R-alpha, IL-6, IL-6R, Ia, Ii, L1-CAM, L1-cell adhesion molecule, Lewis Y, L1-CAM, MAGE A3, MAGE-A1, MART-1, MUC1, NKG2C ligands, NKG2D Ligands, NY-ESO-1, OEPHa2, PIGF, PSCA, PSMA, ROR1, T101, TAC, TAG72, TIM-3, TRAIL-R1, TRAIL-R1 (DR4), TRAIL-R2 (DR5), VEGF, VEGFR2, WT-1, a G-protein coupled receptor, alphafetoprotein (AFP), an angiogenesis factor, an exogenous cognate binding molecule (ExoCBM), oncogene product, anti-folate receptor, c-Met, carcinoembryonic antigen (CEA), cyclin (D1), ephrinB2, epithelial tumor antigen, estrogen receptor, fetal acethycholine e receptor, folate binding protein, gp100, hepatitis B surface antigen, kappa chain, kappa light chain, kdr, lambda chain, livin, melanoma-associated antigen, mesothelin, mouse double minute 2 homolog (MDM2), mucin 16 (MUC16), mutated p53, mutated ras, necrosis antigens, oncofetal antigen, ROR2, progesterone receptor, prostate specific antigen, tEGFR, tenascin, β2-Microglobulin, Fc Receptor-like 5 (FcRL5), or molecules expressed by HIV, HCV, HBV, or other pathogens.

10. The CAR molecule of claim 1, wherein the antigen binding domain comprises an antibody, an antibody fragment, an scFv, a Fv, a Fab, a (Fab')2, a single domain antibody (SDAB), a VH or VL domain, or a camelid VHH domain.

11. The CAR molecule of claim 1, wherein the transmembrane domain comprises a transmembrane domain of a protein chosen from the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and NKG2C, or a functional variant thereof.

12. A chimeric antigen receptor (CAR) molecule comprising:
   i) an antigen binding domain,
   ii) a transmembrane domain, and
   iii) an intracellular domain that comprises a costimulatory domain that comprises the amino acid sequence of RSKRSRLLHSDYMFMTPRRPGPTRKHYQPYAPPRDFAAYRS (SEQ ID NO: 2, wherein the intracellular domain further comprises a primary signaling domain.

* * * * *

UNITED STATES PATENT AND TRADEMARK OFFICE
CERTIFICATE OF CORRECTION

PATENT NO. : 11,535,662 B2  
APPLICATION NO. : 16/481181  
DATED : December 27, 2022  
INVENTOR(S) : Posey et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 632 days.

Signed and Sealed this  
Fourteenth Day of January, 2025

Derrick Brent  
*Acting Director of the United States Patent and Trademark Office*